United States Patent

(12) United States Patent
Middleton et al.

(10) Patent No.: US 8,420,312 B2
(45) Date of Patent: Apr. 16, 2013

(54) GENES ASSOCIATED WITH CANINE OSTEOARTHRITIS AND RELATED METHODS AND COMPOSITIONS

(75) Inventors: Rondo P. Middleton, Creve Coeur, MO (US); Steven S. Hannah, Chesterfield, MO (US)

(73) Assignee: Nestec S.A., Vevy (CH)

( * ) Notice: Subject to any disclaimer, the term of this patent is extended or adjusted under 35 U.S.C. 154(b) by 1223 days.

(21) Appl. No.: 10/587,791

(22) PCT Filed: Feb. 2, 2005

(86) PCT No.: PCT/US2005/003375
§ 371 (c)(1),
(2), (4) Date: Jun. 18, 2007

(87) PCT Pub. No.: WO2005/075685
PCT Pub. Date: Aug. 18, 2005

(65) Prior Publication Data
US 2007/0298416 A1 Dec. 27, 2007

Related U.S. Application Data

(60) Provisional application No. 60/541,346, filed on Feb. 2, 2004.

(51) Int. Cl.
*C07H 21/04* (2006.01)
*C12Q 1/68* (2006.01)
(52) U.S. Cl.
USPC ......... 435/6.1; 435/6.11; 435/6.12; 435/91.1; 435/91.2; 536/23.1; 536/24.3
(58) Field of Classification Search .................. None
See application file for complete search history.

(56) References Cited

FOREIGN PATENT DOCUMENTS

WO WO 02/070737 * 9/2002
WO WO 2004/063324 * 7/2004

OTHER PUBLICATIONS

Matyas, John et al. Discoordinate gene expression of aggrecan and type II collagen in experimental osteoarthritis. 1995. Arthritis and Rheumatism. vol. 38 No. 3 pp. 420-425.*
Whitehead, Andrew et al. Variation in tissue specific gene expression among natural populations. Jan. 2005 Genome Biology. vol. 6 Issue 2 Article R13.*
GenBank Accession BU747049 GI 23697578 Oct. 2002.*
Hoshikawa, Yasushit et al. Hypoxia induces different genes in the lungs of rats compared with mice. Physical Genomics 2003 vol. 12 pp. 209-219.*
Juppner Functional properties of the PTH/PTHrP receptor. Bone 1995 vol. 17 No. 2 Supplement 39S-42S.*
Adams, M.D. et al., "Initial Assessment of Human Gene Diversity and Expression Patterns Based Upon 83 Million Nucleotides of cDNA Sequence," *Nature*, vol. 377(6547 Suppl.), pp. 3-174, 1995.
Adams, M.D. et al., "Complementary DNA Sequencing: Expressed Sequence Tags and Human Genome Project," *Science*, vol. 252(5013), pp. 1651-1656, 1991.
Carulli, J.P. et al., "High Throughput Analysis of Differential Gene Expression," *Journal of Cellular Biochemistry Supplements*, vol. 30/31, pp. 286-296, 1998.
Going, J.J. et al., "Molecular Pathology and Future Developments," *European J. Cancer*, vol. 35(14), pp. 1895-1904, 1999.
Ketting, R.F. et al., "Dicer Functions in RNA Interference and in Synthesis of Small RNA Involved in Developmental Timing in *C. Elegans*," *Genes Development*, vol. 15, pp. 2654-2659, 2001.
Kozian, D.H. et al., "Comparative Gene-Expression Analysis," *Trends in Biotechnology*, vol. 17, pp. 73-78, 1999.
Liang, P. et al., "Differential Display of Eukaryotic Messenger RNA by Means of the Polymerase Chain Reaction," *Science*, vol. 257(5072), pp. 967-970, 1992.
Lotz, M. et al.,"Mechanisms of Chondrocyte Apoptosis," *Osteoarthritis and Cartilage*, vol. 7(4), pp. 389-391, 1999.
Martinez, S.A., "Congenital Conditions that Lead to Osteoarthritis in the Dog," *Vet. Clinical North American Small Animal Practice*, vol. 27(4), pp. 735-758, 1997.
Martinez, S.A. et al., "Acquired Conditions that Lead to Osteoarthritis in the Dog," *Vet. Clinical of N. Am.: Small Animal Practice*, vol. 27(4), pp. 759-775, 1997.
Pelletier,J.P. et al., "Osteoarthritis, an Inflammatory Disease: Potential Implication for the Selection of New Therapeutic Targets," *Arthritis & Rheumatism*, vol. 44(6), pp. 1237-1247, 2001.
Richardson, D.C. et al., "Nutritional Management of Osteoarthritis," *Vet. Clinical North American Small Animal Practice*, vol. 27, pp. 883-911, 1997.
Schena, M. et al., "Quantitative Monitoring of Gene Expression Patterns with a Complementary DNA Microarray," *Science*, vol. 270, pp. 467-470, 1995.
Wang, X. et al., "The Use of mRNA Differential Display for Discovery of Novel Therapeutic Targets in Cardiovascular Disease," *Cardiovascular Research*, vol. 35, pp. 414-421, 1997.
Welsh, J. et al., "Arbitrarily Primed PCR Fingerprinting of RNA," *Nucleic Acids Research*, vol. 20(19), pp. 4965-4970, 1992.

* cited by examiner

*Primary Examiner* — Jeanine A Goldberg
(74) *Attorney, Agent, or Firm* — Potter Anderson & Corroon, LLP

(57) ABSTRACT

Described herein is a combination containing polynucleotide molecules that are differentially expressed in osteoarthritis. Also described are methods that may be used for diagnosis and prognosis of osteoarthritis, as well as methods that may be used to screen test substances for effectiveness in treatment modalities for osteoarthritis. Also described are devices and kits that may be used with the described methods.

8 Claims, 7 Drawing Sheets

US 8,420,312 B2

GENES ASSOCIATED WITH CANINE OSTEOARTHRITIS AND RELATED METHODS AND COMPOSITIONS

CROSS-REFERENCE TO RELATED APPLICATIONS

This application claims benefit of U.S. Application No. 60/541,346, filed Feb. 2, 2004, the disclosure of which is hereby incorporated by reference in its entirety.

REFERENCE TO SEQUENCE LISTING ON COMPACT DISK

This disclosure includes a Sequence Listing submitted under §1.821(c) on compact disc. The compact disc, created Jun. 18, 2007, is entitled "NEST 0021" and contains one Sequence Listing filed in ASCII text format, in accordance with 37 C.F.R. 1.821(c). The Sequence Listing file is entitled "NEST0021.5T25.txt", and comprises SEQ ID NOs.:1 through 1611 in 692 kilobytes of disk space. The entire contents of the compact disc, the NEST0021.5T25.txt, and each of SEQ ID NOs:1 through 1611, are incorporated herein by reference.

FIELD OF THE INVENTION

This invention relates to the field of degenerative joint diseases, such as osteoarthritis. More particularly, the invention relates to novel compositions, devices and methods based on unique profiles of gene expression associated with osteoarthritis.

BACKGROUND OF THE INVENTION

Osteoarthritis (OA), also commonly referred to as degenerative joint disease, is recognized in humans and all veterinary species (Richardson et al., (1997) *Vet. Clin. North Am.* 27:883-911). OA is a prevalent and debilitating disease in canines and is often associated with hip dysplasia (Martinez, S. (1997) Osteoarthritis, Vet. Clinics of N. Am.: Small Animal Practice 27 (4):735-758.). There is a high degree of similarity between canine and human osteoarthritis, thus making it an excellent animal model for the study of human osteoarthritis. While causative factors remain largely unknown, the disease is characterized by the imbalance of cartilage matrix degradation outweighing cartilage matrix synthesis. Chondrocyte apoptosis and inflammation may also be associated with the disease (Pelletier, J., et al. (2001) *Arthritis & Rheumatism* 44 (6):1237-1247; Lotz, M. (1999) *Osteoarthritis and Cartilage* 7: 389-391).

The disease is typically slow in progression and characterized by degeneration of articular cartilage with a loss of both proteoglycan and collagen and by proliferation of new bone. In addition, an inflammatory response can occur within the synovial membrane. Canine osteoarthritis can arise as a secondary condition resulting, in particular, from hip displasia or from osteochondritis dissecans (Martinez, supra). Acquired conditions involving traumatic events can also lead to osteoarthritis in the dog (Martinez et al., *Vet. Clin. North Am.* 27:759-775, 1997). Treatment modalities for osteoarthritis can include the administration of anti-inflammatory drugs as well as the manipulation of dietary fatty acids (Richardson et al., supra).

Diagnosis of canine osteoarthritis is typically based upon symptomotology. Dogs having osteoarthritis show a lameness which may have a gradual onset but can flare up acutely after exercise. The lameness is exacerbated by rest but decreases after a few minutes of activity. Cold damp conditions, obesity and prolonged exercise often worsen signs of lameness (Pederson et al, in *Textbook of Veterinary Internal Medicine,* 5th Ed., Ettinger et al., ed., W.B. Saunders and Co., Philadelphia, 2000, pp. 1862-1886).

With the emergence of the genomic sciences, it has become apparent that not only is the regulation of gene expression intimately involved in normal homeostasis, alterations in the differential expression of genes is one aspect in the development of diseases. As a result, the evaluation of gene expression patterns in disease has become increasingly recognized as being crucial to the understanding of disease processes at the molecular level. (Going et al., *European J. Cancer* 35:1895-1904, 1999; Wang et al., *Cardiovasc. Res.* 35:414-421). A number of approaches have emerged for studying comparative gene expression and the current emphasis has been on high throughput analysis methods. (for review see Carulli et al, *J. Cell. Biochem. Suppl.* 30/32:286-296, 1998; Kozian et al., *Trends Biotechnol* 17:73-78, 1999). Recent methods developed for high throughput analysis of differential gene expression include, for example, EST sequencing (Adams et al., *Science* 252:1651-1656, 1991; Adams et al., *Nature* 377:3-16, 1995), microarray hybridization (Schena et al., *Science* 270:467-470, 1995), and differential display (Liang et al., *Science* 257:967-970, 1992; Welsh et al., *Nucleic Acids Res.* 20:4965-4970, 1992).

Gene expression in osteoarthritis, and particularly in canine osteoarthritis, has not been comprehensively studied. Accordingly, a need exists to identify nucleic acid sequences and their encoded proteins which are differentially expressed in osteoarthritis. This information would be useful to diagnose the osteoarthritic disease state, or pre-disposition to the disease, in a subject, as well as to identify substances useful in the treatment or prevention of osteoarthritis.

SUMMARY OF THE INVENTION

In accordance with an aspect of the present invention, a number of polynucleotides comprising at least a fragment of a gene have been identified as being differentially expressed in osteoarthritic or pre-osteoarthritic subjects, compared to expression in subjects which are not osteoarthritic or pre-osteoarthritic.

In accordance with an aspect of the present invention, differentially expressed genes, gene fragments, and encoded gene products, as well as the expression patterns associated with the group of genes, are used to advantage in a number of methods for the detection of changes in gene expression associated with osteoarthritis, particularly canine osteoarthritis. Additional aspects of the invention relate to methods for the identification of agents useful in treating and/or preventing osteoarthritis.

In accordance with additional aspects of the present invention, compositions, devices and test kits are provided to facilitate the practice of methods provided according to certain embodiments of the invention.

Other features and advantages of the present invention will be understood by reference to the detailed description and the examples that follow.

TABLE 1

Figure 1A:
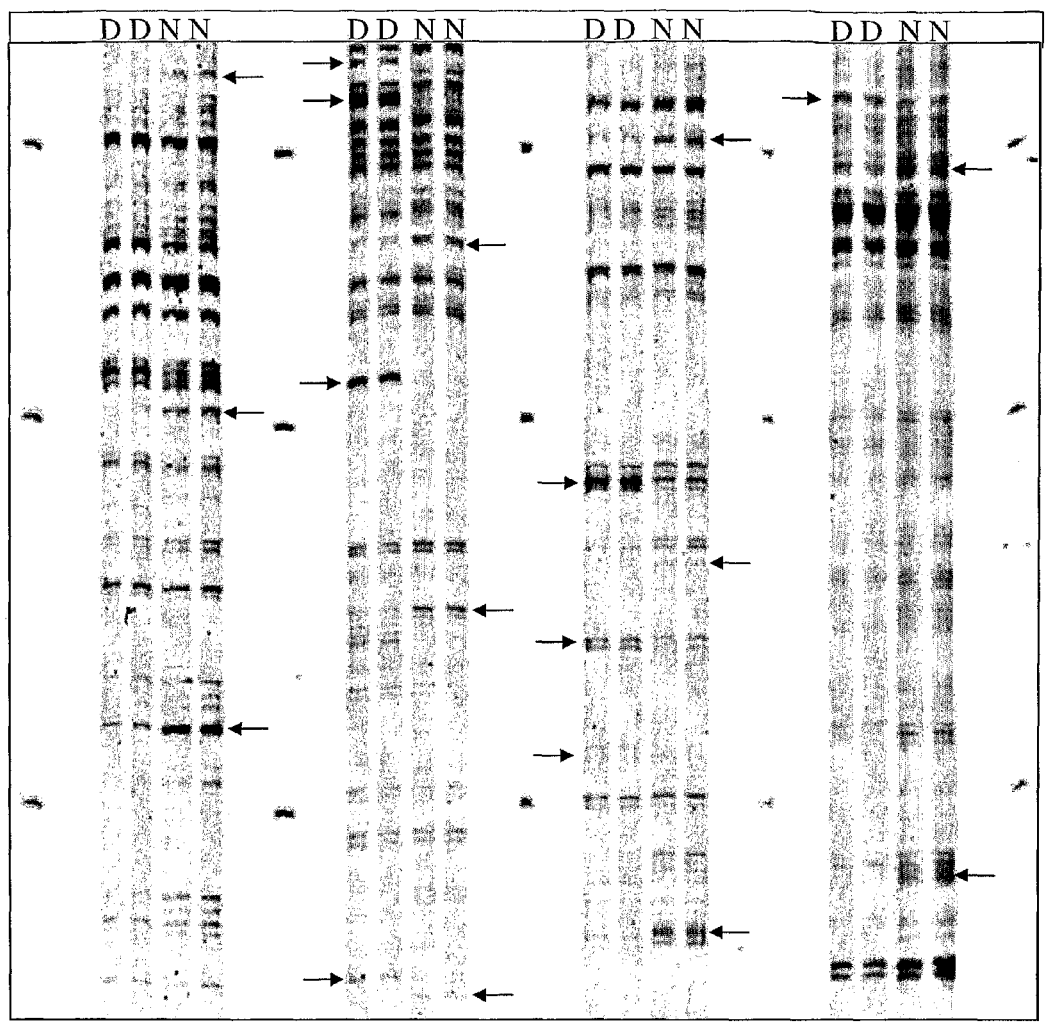
FIG. 1 shows representative gels used in differential display analysis of canine osteoarthritis. A. Differential display of osteoarthritic vs. normal transcripts loaded in duplicate prior to band excision (D=osteoarthritic (Diseased), N=Normal). B. The same gel after band excision.

Correlation of Gene ID Numbers with Sequence ID Numbers.

| Gene ID | SEQ ID | Gene ID | SEQ ID | Gene ID | SEQ ID | Gene ID | SEQ ID |
|---|---|---|---|---|---|---|---|
| 1028c | 1 | 768a | 2 | 141c | 3 | 1548c | 4 |
| 1357a | 5 | 168c | 6 | 383d | 7 | 2127c | 8 |
| 530b | 9 | 1405c | 10 | 1765a | 11 | 166a | 12 |
| 1797a | 13 | 1729a | 14 | 1857c | 15 | 523a | 16 |
| 2172c | 17 | 58a | 18 | 244a | 19 | 70d | 20 |
| 1472a | 21 | 452a | 22 | 1481c | 23 | 1940e | 24 |
| 1930a | 25 | 739a | 26 | 1612a | 27 | 14a | 28 |
| 1727a | 29 | 1220b | 30 | 33a | 31 | 1146a | 32 |
| 1738b | 33 | 810a | 34 | 1993b | 35 | 2147a | 36 |
| 1678a | 37 | 56a | 38 | 1814c | 39 | 129b | 40 |
| 1924a | 41 | 557b | 42 | 1254a | 43 | 1292c | 44 |
| 2221c | 45 | 490c | 46 | 907a | 47 | 469d | 48 |
| 713a | 49 | 1372a | 50 | 482a | 51 | 1098a | 52 |
| 1785a | 53 | 1624b | 54 | 1441d | 55 | 553b | 56 |
| 2179a | 57 | 1257c | 58 | 1506a | 59 | 1939c | 60 |
| 2007a | 61 | 13a | 62 | 1288a | 63 | 1949a | 64 |
| 142.2c | 65 | 1054a | 66 | 1404c | 67 | 8a | 68 |
| 46a | 69 | 1985a | 70 | 326e | 71 | 85.1c | 72 |
| 1675a | 73 | 574a | 74 | 2159b | 75 | 2108b | 76 |
| 45.1b | 77 | 2173a | 78 | 1676a | 79 | 581a | 80 |
| 1695a | 81 | 1414b | 82 | 151b | 83 | 112d | 84 |
| 461a | 85 | 1615b | 86 | 310h | 87 | 297a | 88 |
| 1801b | 89 | 23a | 90 | 1739a | 91 | 170a | 92 |
| 1955a | 93 | 2088a | 94 | 2243b | 95 | 1440a | 96 |
| 2351c | 97 | 1415b | 98 | 2074b | 99 | 2250a | 100 |
| 1740a | 101 | 81a | 102 | 1248b | 103 | 82b | 104 |
| 1147a | 105 | 12a | 106 | 2201a | 107 | 2266b | 108 |
| 795a | 109 | 206a | 110 | 327f | 111 | 212a | 112 |
| 2083e | 113 | 555b | 114 | 1296a | 115 | 272d | 116 |
| 1709a | 117 | 1945a | 118 | 1631d | 119 | 24a | 120 |
| 1284a | 121 | 184a | 122 | 936b | 123 | 1a | 124 |
| 1677b | 125 | 747a | 126 | 737a | 127 | 2166a | 128 |
| 479c | 129 | 2040d | 130 | 1502a | 131 | 72a | 132 |
| 1917f | 133 | 1650a | 134 | 1620a | 135 | 1951a | 136 |
| 2355c | 137 | 1394b | 138 | 2071a | 139 | 340a | 140 |
| 368b | 141 | 736a | 142 | 17a | 143 | 1475a | 144 |
| 143.2c | 145 | 1540a | 146 | 1521b | 147 | 2156c | 148 |
| 2035d | 149 | 1919a | 150 | 1648a | 151 | 1241a | 152 |
| 1713a | 153 | 144.2a | 154 | 2255a | 155 | 690a | 156 |
| 2163a | 157 | 979a | 158 | 1747a | 159 | 507a | 160 |
| 890a | 161 | 395a | 162 | 1309b | 163 | 1462a | 164 |
| 1086c | 165 | 1313a | 166 | 1439b | 167 | 153b | 168 |
| 1790a | 169 | 961a | 170 | 493a | 171 | 1463a | 172 |
| 172a | 173 | 1454d | 174 | 1143a | 175 | 766b | 176 |
| 1412b | 177 | 1423b | 178 | 850a | 179 | 148a | 180 |
| 1696a | 181 | 1396b | 182 | 2141a | 183 | 1503c | 184 |
| 639a | 185 | 1682a | 186 | 2153a | 187 | 2241a | 188 |
| 2263b | 189 | 1438a | 190 | 2059b | 191 | 1646a | 192 |
| 465b | 193 | 990a | 194 | 1488b | 195 | 1452a | 196 |
| 1270a | 197 | 2142a | 198 | 945a | 199 | 1367a | 200 |
| 2198b | 201 | 1139a | 202 | 1138a | 203 | 1008a | 204 |
| 552a | 205 | 2374a | 206 | 1532a | 207 | 2118a | 208 |
| 1366a | 209 | 1262b | 210 | 144.1c | 211 | 21a | 212 |
| 1246a | 213 | 1253a | 214 | 2224a | 215 | 1015d | 216 |
| 2252b | 217 | 154a | 218 | 718a | 219 | 11b | 220 |
| 363a | 221 | 370a | 222 | 1551a | 223 | 376a | 224 |
| 84.2c | 225 | 380a | 226 | 372a | 227 | 2148a | 228 |
| 1800a | 229 | 1090d | 230 | 60a | 231 | 96e | 232 |
| 2015e | 233 | 128a | 234 | 621b | 235 | 1174d | 236 |
| 947a | 237 | 1964a | 238 | 619b | 239 | 2222b | 240 |
| 1468c | 241 | 1629a | 242 | 174a | 243 | 2085c | 244 |
| 1461a | 245 | 764b | 246 | 731a | 247 | 1051a | 248 |
| 613a | 249 | 531a | 250 | 1471a | 251 | 1381a | 252 |
| 44c | 253 | 1892a | 254 | 76b | 255 | 366a | 256 |
| 994b | 257 | 1954e | 258 | 409a | 259 | 2120a | 260 |

TABLE 1-continued

Correlation of Gene ID Numbers with Sequence ID Numbers.

| Gene ID | SEQ ID | Gene ID | SEQ ID | Gene ID | SEQ ID | Gene ID | SEQ ID |
|---|---|---|---|---|---|---|---|
| 638b | 261 | 329d | 262 | 1853a | 263 | 2247a | 264 |
| 1746a | 265 | 1081a | 266 | 2002c | 267 | 785b | 268 |
| 1092b | 269 | 1784a | 270 | 1511b | 271 | 1812b | 272 |
| 1885c | 273 | 1619a | 274 | 2344a | 275 | 1477a | 276 |
| 360a | 277 | 568a | 278 | 1109a | 279 | 1282b | 280 |
| 1276a | 281 | 1728a | 282 | 1923b | 283 | 2020b | 284 |
| 556b | 285 | 1711a | 286 | 49a | 287 | 1271a | 288 |
| 1497c | 289 | 967b | 290 | 1329a | 291 | 464b | 292 |
| 1490a | 293 | 188b | 294 | 178a | 295 | 631b | 296 |
| 1244b | 297 | 758b | 298 | 1807a | 299 | 276a | 300 |
| 204a | 301 | 543a | 302 | 1764a | 303 | 711a | 304 |
| 35c | 305 | 1401c | 306 | 3c | 307 | 494a | 308 |
| 1616a | 309 | 1070b | 310 | 1928a | 311 | 597c | 312 |
| 1505c | 313 | 1941e | 314 | 742a | 315 | 1299c | 316 |
| 1960a | 317 | 1191a | 318 | 562a | 319 | 2223a | 320 |
| 2099a | 321 | 342a | 322 | 1347a | 323 | 738b | 324 |
| 1744a | 325 | 1918a | 326 | 1060a | 327 | 1224b | 328 |
| 861c | 329 | 2033a | 330 | 1349b | 331 | 715a | 332 |
| 1621a | 333 | 379a | 334 | 570b | 335 | 1504d | 336 |
| 441a | 337 | 1943a | 338 | 1033c | 339 | 1758a | 340 |
| 1772a | 341 | 1707c | 342 | 1474a | 343 | 1920a | 344 |
| 34a | 345 | 2205a | 346 | 1712a | 347 | 1010a | 348 |
| 1382d | 349 | 269b | 350 | 1972a | 351 | 1298a | 352 |
| 567b | 353 | 949c | 354 | 1545b | 355 | 472a | 356 |
| 1557a | 357 | 489c | 358 | 1495a | 359 | 1302a | 360 |
| 18a | 361 | 182a | 362 | 991b | 363 | 1513b | 364 |
| 992a | 365 | 1032d | 366 | 1373a | 367 | 1400a | 368 |
| 226a | 369 | 1354a | 370 | 1953a | 371 | 794a | 372 |
| 1604a | 373 | 1245b | 374 | 192a | 375 | 1398a | 376 |
| 1651a | 377 | 64.2a | 378 | 2161c | 379 | 1618b | 380 |
| 1516a | 381 | 1803a | 382 | 1593b | 383 | 2109a | 384 |
| 392a | 385 | 1533a | 386 | 1317a | 387 | 1137b | 388 |
| 51a | 389 | 1708a | 390 | 862c | 391 | 1371a | 392 |
| 2117b | 393 | 1818a | 394 | 851d | 395 | 2113a | 396 |
| 99b | 397 | 92c | 398 | 91f | 399 | 90c | 400 |
| 86.2d | 401 | 86.1d | 402 | 83d | 403 | 80.1b | 404 |
| 7a | 405 | 78e | 406 | 74c | 407 | 73b | 408 |
| 6b | 409 | 68a | 410 | 67a | 411 | 66a | 412 |
| 65.2a | 413 | 63a | 414 | 62c | 415 | 59a | 416 |
| 57a | 417 | 55a | 418 | 52a | 419 | 50.1c | 420 |
| 4a | 421 | 43a | 422 | 38a | 423 | 37c | 424 |
| 35b | 425 | 2b | 426 | 29a | 427 | 27a | 428 |
| 26a | 429 | 25a | 430 | 22b | 431 | 20a | 432 |
| 19c | 433 | 16b | 434 | 15b | 435 | 10c | 436 |
| 102a | 437 | 103a | 438 | 104a | 439 | 106a | 440 |
| 111a | 441 | 120a | 442 | 121b | 443 | 122c | 444 |
| 123c | 445 | 124a | 446 | 126a | 447 | 130b | 448 |
| 131a | 449 | 132a | 450 | 134b | 451 | 135a | 452 |
| 136b | 453 | 142.1c | 454 | 145b | 455 | 146b | 456 |
| 147b | 457 | 150a | 458 | 152b | 459 | 157b | 460 |
| 158a | 461 | 159a | 462 | 161b | 463 | 162b | 464 |
| 164c | 465 | 165a | 466 | 173a | 467 | 175a | 468 |
| 176a | 469 | 177a | 470 | 179b | 471 | 180a | 472 |
| 183a | 473 | 185a | 474 | 186a | 475 | 187b | 476 |
| 189a | 477 | 190b | 478 | 191a | 479 | 195a | 480 |
| 196a | 481 | 197b | 482 | 127b | 483 | 105e | 484 |
| 107.1a | 485 | 107.2a | 486 | 108a | 487 | 109a | 488 |
| 117.1d | 489 | 117.2b | 490 | 137b | 491 | 140b | 492 |
| 194c | 493 | 181d | 494 | 198e | 495 | 199d | 496 |
| 200a | 497 | 201a | 498 | 202a | 499 | 203a | 500 |
| 205a | 501 | 208c | 502 | 209a | 503 | 210a | 504 |
| 211b | 505 | 214a | 506 | 215a | 507 | 216a | 508 |
| 217b | 509 | 218e | 510 | 219g | 511 | 220d | 512 |
| 221b | 513 | 222b | 514 | 223a | 515 | 224a | 516 |
| 225a | 517 | 227a | 518 | 228a | 519 | 229a | 520 |
| 230a | 521 | 231a | 522 | 232a | 523 | 233b | 524 |
| 234a | 525 | 235a | 526 | 236a | 527 | 237c | 528 |
| 238a | 529 | 239a | 530 | 240a | 531 | 241a | 532 |
| 242a | 533 | 243a | 534 | 245a | 535 | 246a | 536 |
| 247a | 537 | 248a | 538 | 249a | 539 | 250a | 540 |
| 251a | 541 | 252a | 542 | 253b | 543 | 254a | 544 |
| 255a | 545 | 257a | 546 | 258a | 547 | 260c | 548 |
| 261c | 549 | 262c | 550 | 263b | 551 | 266d | 552 |
| 267d | 553 | 268b | 554 | 270b | 555 | 273a | 556 |
| 274b | 557 | 275b | 558 | 277a | 559 | 278a | 560 |

TABLE 1-continued

Correlation of Gene ID Numbers with Sequence ID Numbers.

| Gene ID | SEQ ID | Gene ID | SEQ ID | Gene ID | SEQ ID | Gene ID | SEQ ID |
|---|---|---|---|---|---|---|---|
| 280c | 561 | 282d | 562 | 283a | 563 | 284b | 564 |
| 285b | 565 | 286a | 566 | 289a | 567 | 291a | 568 |
| 292b | 569 | 294a | 570 | 295a | 571 | 296a | 572 |
| 299a | 573 | 301b | 574 | 302a | 575 | 499a | 576 |
| 498a | 577 | 497a | 578 | 496c | 579 | 495a | 580 |
| 491a | 581 | 359a | 582 | 351b | 583 | 344a | 584 |
| 343b | 585 | 338a | 586 | 337c | 587 | 336a | 588 |
| 335a | 589 | 334a | 590 | 328b | 591 | 325b | 592 |
| 324a | 593 | 312a | 594 | 311c | 595 | 309a | 596 |
| 308c | 597 | 307b | 598 | 306b | 599 | 303a | 600 |
| 300b | 601 | 163a | 602 | 573b | 603 | 561b | 604 |
| 560b | 605 | 559c | 606 | 554c | 607 | 551b | 608 |
| 549a | 609 | 542a | 610 | 540a | 611 | 539a | 612 |
| 538a | 613 | 537c | 614 | 536a | 615 | 535a | 616 |
| 534b | 617 | 533b | 618 | 527a | 619 | 526a | 620 |
| 521b | 621 | 520a | 622 | 519a | 623 | 517c | 624 |
| 516a | 625 | 515a | 626 | 514a | 627 | 513a | 628 |
| 512b | 629 | 509b | 630 | 508a | 631 | 505b | 632 |
| 504a | 633 | 503a | 634 | 502a | 635 | 501b | 636 |
| 500a | 637 | 345b | 638 | 362b | 639 | 364a | 640 |
| 367a | 641 | 369a | 642 | 371a | 643 | 374a | 644 |
| 377b | 645 | 378a | 646 | 381a | 647 | 386b | 648 |
| 389c | 649 | 390a | 650 | 391a | 651 | 393b | 652 |
| 397b | 653 | 455c | 654 | 456c | 655 | 457c | 656 |
| 458b | 657 | 459a | 658 | 462b | 659 | 466b | 660 |
| 474a | 661 | 478a | 662 | 480a | 663 | 483a | 664 |
| 484a | 665 | 485f | 666 | 486a | 667 | 487a | 668 |
| 488a | 669 | 545a | 670 | 548c | 671 | 558a | 672 |
| 571a | 673 | 572b | 674 | 578c | 675 | 579a | 676 |
| 582c | 677 | 584b | 678 | 587b | 679 | 590a | 680 |
| 595a | 681 | 684a | 682 | 685a | 683 | 686b | 684 |
| 687a | 685 | 688a | 686 | 691a | 687 | 692a | 688 |
| 695a | 689 | 696a | 690 | 697a | 691 | 698a | 692 |
| 699a | 693 | 700a | 694 | 701a | 695 | 702a | 696 |
| 704b | 697 | 706b | 698 | 708a | 699 | 709a | 700 |
| 710a | 701 | 712a | 702 | 714a | 703 | 716b | 704 |
| 717b | 705 | 719a | 706 | 720a | 707 | 722b | 708 |
| 723a | 709 | 724a | 710 | 725a | 711 | 727a | 712 |
| 728b | 713 | 730b | 714 | 732a | 715 | 733a | 716 |
| 734a | 717 | 740b | 718 | 741b | 719 | 743a | 720 |
| 744a | 721 | 745a | 722 | 748a | 723 | 749a | 724 |
| 752a | 725 | 753b | 726 | 754d | 727 | 757a | 728 |
| 759b | 729 | 761a | 730 | 762a | 731 | 763d | 732 |
| 765a | 733 | 770b | 734 | 773a | 735 | 774a | 736 |
| 775a | 737 | 780a | 738 | 781a | 739 | 783a | 740 |
| 784a | 741 | 786a | 742 | 787b | 743 | 788a | 744 |
| 789a | 745 | 791b | 746 | 792a | 747 | 797a | 748 |
| 798a | 749 | 799a | 750 | 969a | 751 | 968a | 752 |
| 966a | 753 | 964a | 754 | 963c | 755 | 959a | 756 |
| 957c | 757 | 956d | 758 | 953a | 759 | 952a | 760 |
| 946a | 761 | 944d | 762 | 943b | 763 | 942b | 764 |
| 939a | 765 | 938b | 766 | 935b | 767 | 934b | 768 |
| 931a | 769 | 930a | 770 | 928a | 771 | 927a | 772 |
| 926a | 773 | 925a | 774 | 923a | 775 | 921c | 776 |
| 919b | 777 | 918a | 778 | 916c | 779 | 915a | 780 |
| 914a | 781 | 913a | 782 | 912b | 783 | 911a | 784 |
| 910c | 785 | 909a | 786 | 906a | 787 | 905a | 788 |
| 904a | 789 | 902a | 790 | 900a | 791 | 899a | 792 |
| 896b | 793 | 894b | 794 | 893a | 795 | 891a | 796 |
| 885a | 797 | 883c | 798 | 843a | 799 | 841b | 800 |
| 839a | 801 | 838b | 802 | 837c | 803 | 836a | 804 |
| 834b | 805 | 833a | 806 | 832a | 807 | 831a | 808 |
| 828a | 809 | 826b | 810 | 824a | 811 | 823a | 812 |
| 821a | 813 | 820a | 814 | 817a | 815 | 816a | 816 |
| 815a | 817 | 813a | 818 | 811a | 819 | 808b | 820 |
| 1633a | 821 | 1632a | 822 | 1627a | 823 | 1625b | 824 |
| 1614b | 825 | 1613b | 826 | 1607a | 827 | 1605b | 828 |
| 1544b | 829 | 1526a | 830 | 1524a | 831 | 1522b | 832 |
| 1520a | 833 | 1519a | 834 | 1518a | 835 | 1514a | 836 |
| 1512a | 837 | 1508a | 838 | 1507a | 839 | 1493a | 840 |
| 1492a | 841 | 1487b | 842 | 1486d | 843 | 1482a | 844 |
| 1480a | 845 | 1476a | 846 | 1469a | 847 | 1466b | 848 |
| 1460a | 849 | 1459c | 850 | 1422a | 851 | 1418a | 852 |
| 1409b | 853 | 1407a | 854 | 1406a | 855 | 1402b | 856 |
| 1399a | 857 | 1397b | 858 | 1369c | 859 | 1364d | 860 |
| 1325b | 861 | 1324a | 862 | 1321a | 863 | 1318a | 864 |
| 1316b | 865 | 1312a | 866 | 1301a | 867 | 1289a | 868 |
| 1285a | 869 | 1277a | 870 | 1273b | 871 | 1272a | 872 |
| 1269b | 873 | 1267a | 874 | 1266a | 875 | 1263b | 876 |
| 1251a | 877 | 1195a | 878 | 1194a | 879 | 1193b | 880 |
| 1192b | 881 | 1189a | 882 | 1188b | 883 | 1185a | 884 |
| 1184a | 885 | 1183a | 886 | 1182a | 887 | 1178a | 888 |
| 1175a | 889 | 1172a | 890 | 1171a | 891 | 1170a | 892 |
| 1167b | 893 | 1166b | 894 | 1132a | 895 | 1126b | 896 |
| 1117a | 897 | 1111b | 898 | 1104b | 899 | 1103a | 900 |
| 1101a | 901 | 1048c | 902 | 1023c | 903 | 1014d | 904 |
| 1009c | 905 | 1239b | 906 | 1240a | 907 | 1243a | 908 |
| 1368a | 909 | 1370a | 910 | 1383a | 911 | 408a | 912 |
| 415b | 913 | 421a | 914 | 443b | 915 | 863c | 916 |
| 864c | 917 | 867d | 918 | 870e | 919 | 874e | 920 |
| 881c | 921 | 940a | 922 | 941a | 923 | 958a | 924 |
| 975a | 925 | 980b | 926 | 981a | 927 | 987a | 928 |
| 993b | 929 | 996a | 930 | 1012a | 931 | 1013a | 932 |
| 1018a | 933 | 1019a | 934 | 1020a | 935 | 1022a | 936 |
| 1026b | 937 | 1029a | 938 | 1031a | 939 | 1034a | 940 |
| 1036a | 941 | 1057b | 942 | 1177c | 943 | 1252a | 944 |
| 1255a | 945 | 1264c | 946 | 1274c | 947 | 1275c | 948 |
| 1279c | 949 | 1281c | 950 | 1286d | 951 | 1287c | 952 |
| 1290d | 953 | 1310a | 954 | 1424a | 955 | 1426a | 956 |
| 1427a | 957 | 1428a | 958 | 1430a | 959 | 1431a | 960 |
| 1432a | 961 | 1435a | 962 | 1436b | 963 | 1437c | 964 |
| 1444b | 965 | 1445b | 966 | 1446a | 967 | 1447a | 968 |
| 1448a | 969 | 1451a | 970 | 1455c | 971 | 1542c | 972 |
| 1549a | 973 | 1611a | 974 | 1639a | 975 | 1641b | 976 |
| 1152d | 977 | 1158c | 978 | 1159b | 979 | 1163d | 980 |
| 1420c | 981 | 1771b | 982 | 1859a | 983 | 1861a | 984 |
| 1886a | 985 | 1889a | 986 | 1900b | 987 | 1905a | 988 |
| 2110a | 989 | 2129a | 990 | 2137a | 991 | 2143a | 992 |
| 2225b | 993 | 2234a | 994 | 2237b | 995 | 2238a | 996 |
| 2239b | 997 | 2248a | 998 | 2267a | 999 | 436c | 1000 |
| 446f | 1001 | 524a | 1002 | 525f | 1003 | 529b | 1004 |
| 541b | 1005 | 547c | 1006 | 563a | 1007 | 564a | 1008 |
| 565a | 1009 | 566a | 1010 | 575b | 1011 | 589a | 1012 |
| 591a | 1013 | 609a | 1014 | 610a | 1015 | 611a | 1016 |
| 612b | 1017 | 614a | 1018 | 617a | 1019 | 620a | 1020 |
| 622a | 1021 | 623a | 1022 | 624b | 1023 | 625a | 1024 |
| 626a | 1025 | 629a | 1026 | 630a | 1027 | 632a | 1028 |
| 633a | 1029 | 634a | 1030 | 637c | 1031 | 640b | 1032 |
| 641a | 1033 | 642a | 1034 | 825d | 1035 | 846a | 1036 |
| 847a | 1037 | 852a | 1038 | 948a | 1039 | 1242a | 1040 |
| 1634a | 1041 | 2138a | 1042 | 2233a | 1043 | 615a | 1044 |
| 618b | 1045 | 628a | 1046 | 636a | 1047 | 835c | 1048 |
| 2122a | 1049 | 1050a | 1050 | 1110b | 1051 | 1228a | 1052 |
| 1655a | 1053 | 1659a | 1054 | 1673b | 1055 | 1694b | 1056 |
| 1703b | 1057 | 1704b | 1058 | 1714a | 1059 | 1717a | 1060 |
| 1718a | 1061 | 1719a | 1062 | 1720a | 1063 | 1721a | 1064 |
| 1722a | 1065 | 1724a | 1066 | 1726a | 1067 | 1730a | 1068 |
| 1731a | 1069 | 1748b | 1070 | 1749a | 1071 | 1750a | 1072 |
| 1751a | 1073 | 1816a | 1074 | 1880a | 1075 | 1884a | 1076 |
| 1887a | 1077 | 1895b | 1078 | 1903a | 1079 | 1912a | 1080 |
| 1914b | 1081 | 1921a | 1082 | 1967a | 1083 | 1968a | 1084 |
| 1977a | 1085 | 1979a | 1086 | 1981a | 1087 | 1982a | 1088 |
| 1986b | 1089 | 1987a | 1090 | 1988a | 1091 | 1990a | 1092 |
| 1992b | 1093 | 1994a | 1094 | 2073b | 1095 | 2075a | 1096 |
| 2076c | 1097 | 2078a | 1098 | 2086a | 1099 | 2092c | 1100 |
| 2093a | 1101 | 2094a | 1102 | 2097a | 1103 | 2100b | 1104 |
| 2104a | 1105 | 2105a | 1106 | 2106a | 1107 | 2111b | 1108 |
| 2119a | 1109 | 2126b | 1110 | 2128a | 1111 | 2132a | 1112 |
| 2135d | 1113 | 2136b | 1114 | 2145c | 1115 | 2149d | 1116 |
| 2150a | 1117 | 2154a | 1118 | 2158c | 1119 | 2160a | 1120 |
| 2162b | 1121 | 2167a | 1122 | 2170a | 1123 | 2171a | 1124 |
| 2174a | 1125 | 2178c | 1126 | 2182b | 1127 | 388a | 1128 |
| 445e | 1129 | 856c | 1130 | 1216a | 1131 | 1705a | 1132 |
| 1725a | 1133 | 1734b | 1134 | 1781a | 1135 | 1782b | 1136 |
| 1789a | 1137 | 1791b | 1138 | 1792a | 1139 | 1794a | 1140 |
| 1795a | 1141 | 1796a | 1142 | 1817a | 1143 | 1897b | 1144 |
| 1971b | 1145 | 2095a | 1146 | 2144a | 1147 | 2146a | 1148 |
| 384c | 1149 | 600e | 1150 | 878c | 1151 | 1011a | 1152 |
| 1021a | 1153 | 1025a | 1154 | 1037c | 1155 | 1039c | 1156 |
| 1040b | 1157 | 1058a | 1158 | 1059a | 1159 | 1061a | 1160 |

TABLE 1-continued

Correlation of Gene ID Numbers with Sequence ID Numbers.

| Gene ID | SEQ ID | Gene ID | SEQ ID | Gene ID | SEQ ID | Gene ID | SEQ ID |
|---|---|---|---|---|---|---|---|
| 1062a | 1161 | 1063b | 1162 | 1064a | 1163 | 1068a | 1164 |
| 1069a | 1165 | 1071b | 1166 | 1072a | 1167 | 1073a | 1168 |
| 1121a | 1169 | 1122b | 1170 | 1130a | 1171 | 1134a | 1172 |
| 1135a | 1173 | 1136b | 1174 | 1176a | 1175 | 1180a | 1176 |
| 1190b | 1177 | 1204a | 1178 | 1208a | 1179 | 1215b | 1180 |
| 1217a | 1181 | 1227b | 1182 | 1236a | 1183 | 1249a | 1184 |
| 1297a | 1185 | 1308c | 1186 | 1314a | 1187 | 1355a | 1188 |
| 1361a | 1189 | 1363b | 1190 | 1386a | 1191 | 1388a | 1192 |
| 1390a | 1193 | 1391a | 1194 | 1417a | 1195 | 1510a | 1196 |
| 1536b | 1197 | 1537c | 1198 | 1546b | 1199 | 1547c | 1200 |
| 1552a | 1201 | 1554c | 1202 | 1556a | 1203 | 1558c | 1204 |
| 1591a | 1205 | 1592a | 1206 | 1594a | 1207 | 1595b | 1208 |
| 1596b | 1209 | 1597a | 1210 | 1598a | 1211 | 1599a | 1212 |
| 1600a | 1213 | 1601a | 1214 | 1602a | 1215 | 1603a | 1216 |
| 1609c | 1217 | 1617a | 1218 | 1626c | 1219 | 1628a | 1220 |
| 1637c | 1221 | 1642a | 1222 | 1657a | 1223 | 1661a | 1224 |
| 1662a | 1225 | 1663a | 1226 | 1665a | 1227 | 1671b | 1228 |
| 1672a | 1229 | 1688c | 1230 | 1691b | 1231 | 1715a | 1232 |
| 1735a | 1233 | 1810a | 1234 | 1856c | 1235 | 1860a | 1236 |
| 1874b | 1237 | 1881b | 1238 | 1901c | 1239 | 1913a | 1240 |
| 2204b | 1241 | 2230a | 1242 | 1035a | 1243 | 1124a | 1244 |
| 1294b | 1245 | 1319a | 1246 | 1411a | 1247 | 1421a | 1248 |
| 1588b | 1249 | 1645a | 1250 | 1667a | 1251 | 1798a | 1252 |
| 450a | 1253 | 1076c | 1254 | 1077a | 1255 | 1085c | 1256 |
| 1087c | 1257 | 1093b | 1258 | 1094b | 1259 | 1102a | 1260 |
| 1106a | 1261 | 1108a | 1262 | 1112a | 1263 | 1116a | 1264 |
| 1335b | 1265 | 1336c | 1266 | 1338a | 1267 | 1339b | 1268 |
| 1341a | 1269 | 1449a | 1270 | 1457c | 1271 | 1458a | 1272 |
| 1479a | 1273 | 1485b | 1274 | 1489a | 1275 | 1499a | 1276 |
| 1501a | 1277 | 1509a | 1278 | 1525a | 1279 | 1531c | 1280 |
| 1534b | 1281 | 1535a | 1282 | 1828b | 1283 | 1834b | 1284 |
| 1927a | 1285 | 1929c | 1286 | 1937c | 1287 | 1942b | 1288 |
| 1944a | 1289 | 1946b | 1290 | 1947a | 1291 | 1948b | 1292 |
| 1950a | 1293 | 1952a | 1294 | 1956a | 1295 | 1958b | 1296 |
| 2003a | 1297 | 2021a | 1298 | 2022a | 1299 | 2023b | 1300 |
| 2024a | 1301 | 2029a | 1302 | 2032b | 1303 | 2053a | 1304 |
| 2056d | 1305 | 2065a | 1306 | 2070a | 1307 | 1334a | 1308 |
| 1453a | 1309 | 2066b | 1310 | 1737a | 1311 | 1741a | 1312 |
| 1779b | 1313 | 1891a | 1314 | 1911b | 1315 | 1922a | 1316 |
| 1067a | 1317 | 1091b | 1318 | 1095a | 1319 | 1105a | 1320 |
| 1131b | 1321 | 1169b | 1322 | 1196b | 1323 | 1213d | 1324 |
| 1222a | 1325 | 1229c | 1326 | 1327a | 1327 | 1346b | 1328 |
| 1358b | 1329 | 1384a | 1330 | 1484b | 1331 | 1500b | 1332 |
| 1693b | 1333 | 1752a | 1334 | 1802a | 1335 | 1871a | 1336 |
| 85.2b | 1337 | 2331c | 1338 | 1687a | 1339 | 1660d | 1340 |
| 1654c | 1341 | 1808a | 1342 | 1425a | 1343 | 1410b | 1344 |
| 1378b | 1345 | 1376a | 1346 | 995a | 1347 | 989a | 1348 |
| 2258a | 1349 | 2084c | 1350 | 1250a | 1351 | 1002b | 1352 |
| 583e | 1353 | 2229a | 1354 | 1001a | 1355 | 1002b | 1356 |
| 1003a | 1357 | 1004a | 1358 | 1005a | 1359 | 1006b | 1360 |
| 1007a | 1361 | 1042a | 1362 | 1044c | 1363 | 1045a | 1364 |
| 1099c | 1365 | 1120a | 1366 | 1125a | 1367 | 1212b | 1368 |
| 1225b | 1369 | 1226d | 1370 | 1304a | 1371 | 1322c | 1372 |
| 1515c | 1373 | 1527a | 1374 | 1528b | 1375 | 1539c | 1376 |
| 1541a | 1377 | 1561a | 1378 | 1690a | 1379 | 1692a | 1380 |
| 1736b | 1381 | 1763b | 1382 | 1766a | 1383 | 1777a | 1384 |
| 1883b | 1385 | 1888c | 1386 | 1898a | 1387 | 2043b | 1388 |
| 2045d | 1389 | 2130a | 1390 | 2139a | 1391 | 213a | 1392 |
| 2140b | 1393 | 2165a | 1394 | 2199a | 1395 | 2210a | 1396 |
| 2254a | 1397 | 2264b | 1398 | 2268a | 1399 | 265a | 1400 |
| 365b | 1401 | 492a | 1402 | 550a | 1403 | 635a | 1404 |
| 726a | 1405 | 750b | 1406 | 772b | 1407 | 776a | 1408 |
| 777a | 1409 | 793a | 1410 | 800b | 1411 | 801b | 1412 |
| 803b | 1413 | 804a | 1414 | 806b | 1415 | 827b | 1416 |
| 855c | 1417 | 877e | 1418 | 880e | 1419 | 932b | 1420 |
| 933b | 1421 | 984a | 1422 | 986a | 1423 | 988b | 1424 |
| 989a | 1425 | 997a | 1426 | 1016b | 1427 | 1027a | 1428 |
| 1030a | 1429 | 1038b | 1430 | 1052b | 1431 | 1053a | 1432 |
| 1088c | 1433 | 1089d | 1434 | 1097c | 1435 | 1145a | 1436 |
| 1165b | 1437 | 1260c | 1438 | 1315c | 1439 | 1348b | 1440 |
| 1352b | 1441 | 1360b | 1442 | 1387b | 1443 | 1403a | 1444 |
| 1413b | 1445 | 1416a | 1446 | 1419a | 1447 | 1442d-r | 1448 |
| 1443a | 1449 | 1450a | 1450 | 1483a | 1451 | 1562a | 1452 |
| 1564a | 1453 | 1565c | 1454 | 1567a | 1455 | 1568a | 1456 |
| 1569b | 1457 | 1570a | 1458 | 1572a | 1459 | 1573a | 1460 |
| 1574b | 1461 | 1575a | 1462 | 1576a | 1463 | 1577a | 1464 |
| 1578a | 1465 | 1579a | 1466 | 1580b | 1467 | 1581a | 1468 |
| 1583a | 1469 | 1584a | 1470 | 1585b | 1471 | 1586a | 1472 |
| 1628d | 1473 | 1630b | 1474 | 1666d | 1475 | 1669d | 1476 |
| 1670d | 1477 | 1755a | 1478 | 1759b | 1479 | 1760c | 1480 |
| 1775a | 1481 | 1778c | 1482 | 1780a | 1483 | 1809a | 1484 |
| 1846d | 1485 | 1849d | 1486 | 1852a | 1487 | 1863c | 1488 |
| 1864b | 1489 | 1865e | 1490 | 1879a | 1491 | 1894a | 1492 |
| 1906a | 1493 | 1961e | 1494 | 1966a | 1495 | 1989b | 1496 |
| 1991d | 1497 | 2008a | 1498 | 2013a | 1499 | 2014f | 1500 |
| 2034a | 1501 | 2036b | 1502 | 2041d | 1503 | 2042h | 1504 |
| 2043b | 1505 | 2044a | 1506 | 2045d | 1507 | 2046a | 1508 |
| 2048a | 1509 | 2101c | 1510 | 2107b | 1511 | 2124a-r | 1512 |
| 2235a | 1513 | 2240a | 1514 | 2251d | 1515 | 2271a | 1516 |
| 2341b | 1517 | 2356a | 1518 | 2358b | 1519 | 2371a | 1520 |
| 2373a | 1521 | 322a | 1522 | 805a | 1523 | 924a | 1524 |
| 965a | 1525 | 898a | 1526 | 879c | 1527 | 865e | 1528 |
| 627b | 1529 | 406a-r | 1530 | 321a | 1531 | 320a | 1532 |
| 319b | 1533 | 317a | 1534 | 315a | 1535 | 314a | 1536 |
| 313a | 1537 | 2249a | 1538 | 2189b | 1539 | 2134b | 1540 |
| 2125a | 1541 | 1811b | 1542 | 1553b | 1543 | 1393b | 1544 |
| 1389b | 1545 | 1377b | 1546 | 1356a | 1547 | 1353a | 1548 |
| 1041a | 1549 | 1635a | 1550 | 1385b | 1551 | 1365a | 1552 |
| 50.2b | 1553 | 48b | 1554 | 440a | 1555 | 413a | 1556 |
| 2123a | 1557 | 1323br | 1558 | | | | |

DETAILED DESCRIPTION OF ILLUSTRATIVE EMBODIMENTS

Definitions

The following definitions are provided to facilitate an understanding of the present invention:

"Nucleic acid" or a "nucleic acid molecule" as used herein refers to any DNA or RNA molecule, either single or double stranded and, if single stranded, the molecule of its complementary sequence in either linear or circular form. In discussing nucleic acid molecules, a sequence or structure of a particular nucleic acid molecule may be described herein according to the normal convention of providing the sequence in the 5' to 3' direction. With reference to nucleic acids according to aspects of the invention, the term "isolated nucleic acid" is sometimes used. This term, when applied to DNA, refers to a DNA molecule that is separated from sequences with which it is immediately contiguous in the naturally occurring genome of the organism in which it originated. For example, an "isolated nucleic acid" may comprise a DNA molecule inserted into a vector, such as a plasmid or virus vector, or integrated into the genomic DNA of a prokaryotic or eukaryotic cell or host organism.

When applied to RNA, the term "isolated nucleic acid" refers primarily to an RNA molecule encoded by an isolated DNA molecule as defined above. Alternatively, the term may refer to an RNA molecule that has been sufficiently separated from other nucleic acids with which it would be associated in its natural state (i.e., in cells or tissues). An isolated nucleic acid (either DNA or RNA) may further represent a molecule produced directly by biological or synthetic means and separated from other components present, during its production.

The terms "percent similarity", "percent identity" and "percent homology" when referring to a particular sequence are used as set forth in the University of Wisconsin GCG software program.

A "polynucleotide," "polynucleotide molecule" or "polynucleotide sequence" refers to a chain of nucleotides. It may refer to a DNA or RNA molecule, either single or double stranded and, if single stranded, the molecule of its complementary sequence in either linear or circular form. Preferably, the chain has from about 50 to 10,000 nucleotides, more preferably from about 150 to 3,500 nucleotides. In some instances, the sequences will be fully complementary (no mismatches) when aligned. In other instances, there may be up to about a 30% mismatch in the sequences.

The term "oligonucleotide," as used herein refers to sequences, primers and probes of the present invention, and is defined as a nucleic acid molecule comprised of two or more ribo or deoxyribonucleotides, preferably more than three. The exact size of the oligonucleotide will depend on various factors and on the particular application and use of the oligonucleotide.

A "fragment" refers to a nucleic acid sequence that is preferably at least about 10 nucleic acids in length, more preferably about 40 nucleic acids, and most preferably about 100 nucleic acids in length and encompasses, for example, fragments consisting of nucleic acids 1-100, 300-400, 500-600, 800-900 of SEQ ID NOs:1-1558 or fragments of similar length at the 3' end of SEQ ID NOs:1-1558. A "fragment" can also mean a stretch of at least about 100 consecutive nucleotides that contains one or more deletions, insertions or substitutions. A "fragment" can also mean the whole coding sequence of a gene and may include 5' and 3' untranslated regions. A "fragment" can also refer to polypeptide sequences which are preferably at least about 5 to about 15 amino acids in length, most preferably at least about 10 amino acids long, and which retain some biological activity or immunological activity of a sequence.

The term "gene" or "genes" refers to the partial or complete coding sequence of a gene. The term also refers to 5' or 3' untranslated regions of a transcript. The phrase "gene differentially expressed in osteoarthritis" refers to a gene whose amount of mRNA expressed from that gene or the amount of gene product translated from the mRNA is detectably different, i.e. either greater or lesser, in cells from subjects having osteoarthritis or in pre-osteoarthritic subjects compared to the amount of mRNA or translated gene product in cells from normal subjects which are neither osteoarthritic nor pre-osteoarthritic. As used herein, "pre-osteoarthritis" or "pre-osteoarthritic" is intended to mean that a subject is predisposed to developing osteoarthritis at a later date, but may not have any overt signs or symptoms of osteoarthritis. Preferably, the abundance of transcription or translation products of a differentially expressed gene derived from an osteoarthritic or pre-osteoarthritic sample differs by least about 1.15 fold, more preferably at least about 1.2 fold, more preferably at least about 1.3 fold, more preferably at least about 1.4 fold, more preferably at least about 1.5 fold, more preferably at least about 1.6 fold, more preferably at least about 1.75 fold, more preferably at least about 2 fold, more preferably at least about 3 fold, more preferably at least about 10 fold, more preferably at least about 20 fold than that in a normal sample. The phrase "gene differentially expressed in osteoarthritis" also refers to genes that are not detectable in the normal transcript profile but are preferably at levels of at least about 2 copies per cell, more preferably at least about 3 copies per cell, in the osteoarthritic or pre-osteoarthritic tissue transcript profile.

The terms "osteoarthritis (OA)-related" and "osteoarthritis (OA)-associated genes" refer to genes that are differentially expressed in osteoarthritis as defined herein.

As used herein, the terms "reporter," "reporter system," "reporter gene," or "reporter gene product" refer to an operative genetic system in which a nucleic acid comprises a gene that encodes a product that when expressed produces a reporter signal that is a readily measurable, e.g., by biological assay, immunoassay, radioimmunoassay, or by calorimetric, fluorogenic, chemiluminescent or other methods. The nucleic acid may be either RNA or DNA, linear or circular, single or double stranded, antisense or sense polarity, and is operatively linked to the necessary control elements for the expression of the reporter gene product. The required control elements will vary according to the nature of the reporter system and whether the reporter gene is in the form of DNA or RNA, but may include, but not be limited to, such elements as promoters, enhancers, translational control sequences, polyA addition signals, transcriptional termination signals and the like.

The terms "transform," "transfect," "transduce," refer to any method or means by which a nucleic acid is introduced into a cell or host organism and may be used interchangeably to convey the same meaning. Such methods include, but are not limited to, transfection, electroporation, microinjection, PEG-fusion and the like.

The term "functional" as used herein implies that the nucleic or amino acid sequence is functional for the recited assay or purpose.

The phrase "consisting essentially of" when referring to a particular nucleotide or amino acid means a sequence having the properties of a given SEQ ID NO. For example, when used in reference to an amino acid sequence, the phrase includes the sequence per se and molecular modifications that would not affect the basic and novel characteristics of the sequence.

A "vector" is a replicon, such as a plasmid, cosmid, bacmid, phage, artificial chromosome (BAC, YAC) or virus, into which another genetic sequence or element (either DNA or RNA) may be inserted so as to bring about the replication of the attached sequence or element. A "replicon" is any genetic element, for example, a plasmid, cosmid, bacmid, phage, artificial chromosome (BAC, YAC) or virus, that is capable of replication largely under its own control. A replicon may be either RNA or DNA and may be single or double stranded.

The term "probe" as used herein refers to either a probe for a nucleic acid or a probe for a protein. When used in connection with nucleic acids, a "probe" refers to an oligonucleotide, polynucleotide or nucleic acid, either RNA or DNA, whether occurring naturally as in a purified restriction enzyme digest or produced synthetically, which is capable of annealing with or specifically hybridizing to a nucleic acid with sequences complementary to the probe. A probe may be either single stranded or double stranded. The exact length of the probe will depend upon many factors, including temperature, source of probe and method of use. For example, for diagnostic applications, depending on the complexity of the target sequence, an oligonucleotide probe typically contains about 10-100, preferably about 15-50, more preferably about 15-25 nucleotides. In certain diagnostic applications, a polynucleotide probe preferably contains about 90-1150 nucleotides, more preferably about 300-600 nucleotides, more preferably about 300 nucleotides. The probes herein are selected to be "substantially" complementary to different strands of a particular target nucleic acid sequence. This means that the probes must be sufficiently complementary so as to be able to "specifically hybridize" or anneal with their respective target strands under a set of pre-determined conditions. Therefore, the probe sequence need not reflect the exact complementary sequence of the target. For example, a non complementary nucleotide fragment may be attached to the 5' or 3' end of the probe, with the remainder of the probe sequence being complementary to the target strand. Alternatively, non complementary bases or longer sequences can be interspersed into the probe, provided that the probe sequence has sufficient complementarity with the sequence of the target nucleic acid to anneal therewith specifically. When used in connection with a protein, a "probe" is a protein binding substance capable of specifically binding a particular protein or protein fragment to the substantial exclusion of other proteins or protein fragments. Such binding substances may be any molecule to which the protein or peptide specifically binds, including DNA (for DNA binding proteins), antibodies (as described in greater detail herein), cell membrane receptors, peptides, cofactors, lectins, sugars, polysaccharides, cells, cell membranes, organelles and organellar membranes.

"Array" refers to an ordered arrangement of at least two probes on a substrate. At least one of the probes represents a control or standard, and the other, a probe of diagnostic interest. The arrangement of from about two to about 40,000 probes on a substrate assures that the size and signal intensity of each labeled complex formed between a probe and a sample nucleic acid or protein binding substance is individually distinguishable.

A "hybridization complex" is formed between nucleic acid molecules of a sample when the purines of one molecule hydrogen bond with the pyrimidines of the complementary molecule, e.g., 5'-A-G-T-C-3' base pairs with 3'-T-C-A-G-5'. The degree of complementarity and the use of nucleotide analogs affect the efficiency and stringency of hybridization reactions.

The term "specifically hybridize" refers to the association between two single stranded nucleic acid molecules of sufficiently complementary sequence to permit such hybridization under predetermined conditions generally used in the art (sometimes termed "substantially complementary"). For example, the term may refer to hybridization of a nucleic acid probe with a substantially complementary sequence contained within a single stranded DNA or RNA molecule according to an aspect of the invention, to the substantial exclusion of hybridization of the nucleic acid probe with single stranded nucleic acids of non-complementary sequence.

"Sample" is used in its broadest sense as containing nucleic acids, proteins, antibodies, and the like. A sample may comprise, for example, a bodily fluid; the soluble fraction of a cell preparation, or an aliquot of media in which cells were grown; a chromosome, an organelle, or membrane isolated or extracted from a cell; genomic DNA, RNA, or cDNA in solution or bound to a substrate; a cell; a tissue or a tissue biopsy; a tissue print; a fingerprint, buccal cells, skin, or hair; and the like.

A "standard" refers to a control sample that comprises material from a source in a normal (as opposed to OA-related) biological state. An OA-related biological state may include, for example, one in which the source has OA, is predisposed to develop OA, or exhibits certain biological characteristics of OA. For example, a standard sample may comprise nucleic acids or proteins from a normal subject that is not osteoarthritic or pre-osteoarthritic. Standard samples may also include samples from normal cells or tissue that have not been treated to elicit an immune response that may model certain aspects of OA.

"Specific binding" refers to a special and precise interaction between two molecules which is dependent upon their structure, particularly their molecular side groups. For example, the intercalation of a regulatory protein into the major groove of a DNA molecule, the hydrogen bonding along the backbone between two single stranded nucleic acids, or the binding between an epitope of a protein and an agonist, antagonist, or antibody.

The term "primer" as used herein refers to a nucleic acid molecule, either RNA or DNA, either single stranded or double stranded, either derived from a biological system, generated by restriction enzyme digestion, or produced synthetically which, when placed in the proper environment, is able to functionally act as an initiator of template-dependent nucleic acid synthesis. When presented with an appropriate nucleic acid template, suitable nucleoside triphosphate precursors of nucleic acids, a polymerase enzyme, suitable cofactors and conditions such as appropriate temperature and pH, the primer may be extended at its 3' terminus by the addition of nucleotides by the action of a polymerase or similar activity to yield an primer extension product. The primer may vary in length depending on the particular conditions and requirement of the application. For example, in diagnostic applications according to particular embodiments of the invention, a primer may be an oligonucleotide primer, preferably about 15-25 or more nucleotides in length. The primer must be of sufficient complementarity to the desired template to prime the synthesis of the desired extension product, that is, to be able anneal with the desired template strand in a manner sufficient to provide the 3' hydroxyl moiety of the primer in appropriate juxtaposition for use in the initiation of synthesis by a polymerase or similar enzyme. It is not required that the primer sequence represent an exact complement of the desired template. For example, a non complementary nucleotide sequence may be attached to the 5' end of an otherwise complementary primer. Alternatively, non complementary bases may be interspersed within the oligonucleotide primer sequence, provided that the primer sequence has sufficient complementarity with the sequence of the desired template strand to functionally provide a template primer complex for the synthesis of the extension product.

Amino acid residues described herein are preferred to be in the "L" isomeric form. However, residues in the "D" isomeric form may be substituted for any L amino acid residue, provided the desired properties of the polypeptide are retained. All amino acid residue sequences represented herein conform to the conventional left-to-right amino terminus to carboxy terminus orientation.

A "fragment" or "portion" of a polypeptide means a stretch of amino acid residues of at least about five to seven contiguous amino acids, often at least about seven to nine contiguous amino acids, typically at least about nine to thirteen contiguous amino acids and, most preferably, at least about twenty to thirty or more contiguous amino acids. Fragments of the polypeptide sequence, antigenic determinants, or epitopes are useful for eliciting immune responses to a portion of the protein amino acid sequence.

Different "variants" of the differentially expressed polypeptides exist in nature. These variants may be alleles characterized by differences in the nucleotide sequences of the gene coding for the protein, or may involve different RNA processing or post translational modifications. The skilled person can produce variants having single or multiple amino acid substitutions, deletions, additions or replacements. These variants may include, inter alia: (a) variants in which one or more amino acids residues are substituted with conservative or non conservative amino acids, (b) variants in which one or more amino acids are added to the polypeptide, (c) variants in which one or more amino acids include a substituent group, and (d) variants in which the polypeptide is fused with another peptide or polypeptide such as a fusion partner, a protein tag or other chemical moiety, that may confer useful properties to the polypeptide, such as, for example, an epitope for an antibody, a polyhistidine sequence, a biotin moiety and the like. Other polypeptides of the invention may include variants in which amino acid residues from one species are substituted for the corresponding residue in another species, either at the conserved or non conserved positions. In another embodiment, amino acid residues at non conserved positions are substituted with conservative or non conservative residues. The techniques for obtaining these variants, including genetic (suppressions, deletions, mutations, etc.), chemical, and enzymatic techniques are known to the person having ordinary skill in the art. To the extent such allelic variations, analogues, fragments, derivatives, mutants, and modifications, including alternative nucleic acid processing forms and alternative post translational modification forms result in derivatives of the differentially expressed polypeptide that retain any of the biological properties of the differentially expressed polypeptide, they are included within the scope of this invention.

The term "isolated protein" or "isolated and purified protein" refers primarily to a protein produced by expression of an isolated nucleic acid molecule according to an aspect the invention. Alternatively, this term may refer to a protein that has been sufficiently separated from other proteins with which it would naturally be associated, so as to exist in "substantially pure" form. "Isolated" is not meant to exclude artificial or synthetic mixtures with other compounds or materials, or the presence of impurities that do not interfere with the fundamental activity, and that may be present, for example, due to incomplete purification, addition of stabilizers, or compounding into, for example, immunogenic preparations or pharmaceutically acceptable preparations.

The term "substantially pure" refers to a preparation comprising at least about 50-60% by weight of a given material (e.g., nucleic acid, protein, etc.). More preferably, the preparation comprises at least about 75% by weight, and most preferably about 90-95% by weight of the given compound. Purity is measured by methods appropriate for the given material (e.g. chromatographic methods, agarose or polyacrylamide gel electrophoresis, HPLC analysis, and the like).

The term "tag," "tag sequence" or "protein tag" refers to a chemical moiety, either a nucleotide, oligonucleotide, polynucleotide or an amino acid, peptide or protein or other chemical, that when added to another sequence, provides additional utility or confers useful properties, particularly in the detection or isolation, of that sequence. Thus, for example, a homopolymer nucleic acid sequence or a nucleic acid sequence complementary to a capture oligonucleotide may be added to a primer or probe sequence to facilitate the subsequent isolation of an extension product or hybridized product. In the case of protein tags, histidine residues (e.g., 4 to 8 consecutive histidine residues) may be added to either the amino or carboxy terminus of a protein to facilitate protein isolation by chelating metal chromatography. Alternatively, amino acid sequences, peptides, proteins or fusion partners representing epitopes or binding determinants reactive with specific antibody molecules or other molecules (e.g., flag epitope, c myc epitope, transmembrane epitope of the influenza A virus hemagglutinin protein, protein A, cellulose binding domain, calmodulin binding protein, maltose binding protein, chitin binding domain, glutathione S transferase, and the like) may be added to proteins to facilitate protein isolation by procedures such as affinity or immunoaffinity chromatography. Chemical tag moieties include such molecules as biotin, which may be added to either nucleic acids or proteins and facilitates isolation or detection by interaction with avidin reagents, and the like. Numerous other tag moieties are known to, and can be envisioned by, the trained artisan, and are contemplated to be within the scope of this definition.

An "antibody" or "antibody molecule" is any immunoglobulin, including antibodies and fragments thereof, that binds to a specific antigen. The term includes polyclonal, monoclonal, chimeric, and bispecific antibodies. As used herein, antibody or antibody molecule contemplates both an intact immunoglobulin molecule and an immunologically active portion of an immunoglobulin molecule such as those portions known in the art as Fab, Fab', F(ab')2 and F(v).

As used herein, the term "subject" or "patient" refers to both humans and animals, unless specified that the "subject" or "patient" is an animal or a human. Animal subjects are preferably vertebrates, and more preferably, mammals.

"Therapeutic modality" refers to any means of treating and/or preventing a disease, condition or disorder.

In one aspect of the present invention, a number of genes have been identified that are differentially expressed in osteoarthritic subjects as compared to non-osteoarthritic subjects. These genes and gene fragments, as well as their encoded proteins and fragments, may be used, for example, in a variety of diagnostic and prognostic assays, as well as assays useful in screening test substances for effectiveness in treatment modalities for osteoarthritis.

In certain embodiments of the invention, expression of at least one differentially expressed gene may be measured. In preferred embodiments, expression of two or more differentially expressed genes may be measured, providing a gene expression pattern or gene expression profile. More preferably, measurement of a multiplicity of differentially expressed genes may be performed, providing additional information for a gene expression pattern or profile.

In various embodiments of the present invention, changes in gene expression may be measured in one or both of two ways: (1) measuring transcription through detection of mRNA produced by a particular gene; and (2) measuring translation through detection of protein produced by a particular transcript.

Decreased or increased expression can be measured at the RNA level using any of the methods well known in the art for the quantitation of polynucleotides, such as, for example, PCR (including, without limitation, RT-PCR and qPCR), RNase protection, Northern blotting and other hybridization methods. The genes that are assayed or interrogated according to the present invention are typically in the form of mRNA or reverse transcribed mRNA. The genes may be cloned and/or amplified. The cloning itself does not appear to bias the representation of genes within a population. However, it may be preferable to use polyA+ RNA as a source, as it can be used with fewer processing steps.

In accordance with aspects of the present invention, 1558 genes have been identified whose functions are closely associated with osteoarthritis (OA). The association is determined by comparing expression of the genes in normal tissue and tissue from subjects diagnosed with OA. The genes so identified fall into two broad categories. The first category comprises known genes, many of whose association with OA had heretofore been unappreciated. These genes are listed in Table 6, along with their corresponding gene ID numbers and SEQ ID NOs.

According to another aspect of the invention, a second category comprises nucleic acid segments that do not demonstrate homology to previously identified sequences. Thus, this category is believed to include one or more novel genes. One preferred embodiment of the invention relates to an isolated nucleic acid molecule comprising a novel OA-associated gene, mRNA or cDNA produced from the OA-associated gene.

One aspect of the present invention relates to a combination of 1558 polynucleotide molecules that are differentially expressed in an osteoarthritic subject or in a pre-osteoarthritic subject compared to expression in subjects which are not osteoarthritic or pre-osteoarthritic. In one embodiment of the invention described herein, segments of 1558 OA-related genes from canine cartilage were obtained by employing differential display. The nucleotide sequences of these polynucleotides are set forth herein as SEQ ID NOs:1-1558 (Table 1 shows the correlation between SEQ ID NO. and Gene ID Number). BLAST analysis of these sequences identified homologies with of a number of nucleic acid sequences previously identified (Table 2) These include a number of previously identified nucleic acid sequences with no identified homologies to known genes. BLAST analysis also identified sequences showing homology to previously-identified genes; information including names of genes as well as database accession numbers for respective homologs of these is provided in Tables 2A and 2B.

TABLE 2A

| CaMax Gene ID | Ensemble Gene ID | Ensemble Transcript ID | Description | Chrom No. | Chrom Loc. |
|---|---|---|---|---|---|
| CaMax: 1002b | | | | | |
| CaMax: 1002b | | | | | |
| CaMax: 1005a | ENSG00000138709 | ENST00000264584 ENST00000326703 ENST00000326639 | | 4 | q28.2 |
| CaMax: 1006b | ENSG00000152518 | ENST00000282388 | BUTYRATE RESPONSE FACTOR 2 (TIS11D PROTEIN) (EGF-RESPONSE FACTOR 2) (ERF-2). [Source: SWISSPROT; Acc: P47974] | 2 | p21 |
| CaMax: 1007a | ENSG00000152518 | ENST00000282388 | BUTYRATE RESPONSE FACTOR 2 (TIS11D PROTEIN) (EGF-RESPONSE FACTOR 2) (ERF-2). [Source: SWISSPROT; Acc: P47974] | 2 | p21 |
| CaMax: 1008a | | | | | |
| CaMax: 1008a | | | | | |
| CaMax: 1009c | ENSG00000122912 | ENST00000265870 | GRAVE'S DISEASE CARRIER PROTEIN (GDC) (GRAVE'S DISEASE AUTOANTIGEN) (GDA) (MITOCHONDRIAL SOLUTE CARRIER PROTEIN HOMOLOG). [Source: SWISSPROT; Acc: P16260] | 10 | q21.3 |
| CaMax: 1011a | | | | | |
| CaMax: 1011a | | | | | |
| CaMax: 1013a | | | | | |
| CaMax: 1015d | ENSG00000109775 | ENST00000264689 | | 4 | q35.1 |
| CaMax: 1016b | | | | | |
| CaMax: 1019a | ENSG00000160961 | ENST00000292530 | ZINC FINGER PROTEIN 333. [Source: SWISSPROT; Acc: Q96JL9] | 19 | p13.12 |
| CaMax: 1020a | ENSG00000064989 | ENST00000264152 | CALCITONIN GENE-RELATED PEPTIDE TYPE 1 RECEPTOR PRECURSOR (CGRP TYPE 1 RECEPTOR). [Source: SWISSPROT; Acc: Q16602] | 2 | q32.1 |
| CaMax: 1026b | | | | | |
| CaMax: 1026b | | | | | |
| CaMax: 1028c | | | | | |
| CaMax: 1028c | | | | | |
| CaMax: 1029a | ENSG00000171567 | ENST00000304782 | TIGGER TRANSPOSABLE ELEMENT DERIVED 1; JERKY (MOUSE) HOMOLOG-LIKE. [Source: RefSeq; Acc: NM_145702] | 2 | q37.1 |
| CaMax: 103a | | | | | |

TABLE 2A-continued

| CaMax Gene ID | Ensemble Gene ID | Ensemble Transcript ID | Description | Chrom No. | Chrom Loc. |
|---|---|---|---|---|---|
| CaMax: 1044c | ENSG00000041880 | ENST00000045065 | POLY [ADP-RIBOSE] POLYMERASE-3 (EC 2.4.2.30) (PARP-3) (NAD(+) ADP-RIBOSYLTRANSFERASE-3) (POLY[ADP-RIBOSE] SYNTHETASE-3) (PADPRT-3) (HPARP-3) (IRT1). [Source: SWISSPROT; Acc: Q9Y6F1] | 3 | p21.2 |
| CaMax: 104a | ENSG00000169045 | ENST00000326748 ENST00000329433 | HETEROGENEOUS NUCLEAR RIBONUCLEOPROTEIN H (HNRNP H). [Source: SWISSPROT; Acc: P31943] | 5 | q35.3 |
| CaMax: 1050a | | | | | |
| CaMax: 1054a | | | | | |
| CaMax: 1057b | | | | | |
| CaMax: 1060a | | | | | |
| CaMax: 1061a | ENSG00000138336 | ENST00000260906 | LEUKEMIA-ASSOCIATED PROTEIN WITH A CXXC DOMAIN. [Source: SPTREMBL; Acc: Q8NFU7] | 10 | q21.3 |
| CaMax: 1063b | | | | | |
| CaMax: 106a | ENSG00000167996 | ENST00000301775 | FERRITIN HEAVY CHAIN (FERRITIN H SUBUNIT). [Source: SWISSPROT; Acc: P02794] | 11 | q12.3 |
| CaMax: 1070b | | | | | |
| CaMax: 1072a | | | | | |
| CaMax: 1072a | | | | | |
| CaMax: 1089d | | | | | |
| CaMax: 108a | | | | | |
| CaMax: 1090d | | | | | |
| CaMax: 1094b | | | | | |
| CaMax: 1094b | | | | | |
| CaMax: 1095a | ENSMUSG00000030693 | ENSMUST00000032941 ENSMUST00000014058 | | 7 | B2 |
| CaMax: 1096a | ENSMUSG00000030693 | ENSMUST00000032941 ENSMUST00000014058 | | 7 | B2 |
| CaMax: 1098a | ENSG00000135426 | ENST00000316577 ENST00000257883 | | 12 | q13.2 |
| CaMax: 109a | ENSG00000138688 | ENST00000264501 ENST00000306802 | | 4 | q27 |
| CaMax: 1105a | ENSG00000119396 | ENST00000238339 | RAS-RELATED PROTEIN RAB-14. [Source: SWISSPROT; Acc: P35287] | 9 | q33.2 |
| CaMax: 1106a | ENSG00000155755 | ENST00000286196 | | 2 | q33.1 |
| CaMax: 1108a | ENSG00000133121 | ENST00000255486 | STAR-RELATED LIPID TRANSFER PROTEIN 13 (STARD13) (START DOMAIN-CONTAINING PROTEIN 13) (46H23.2). [Source: SWISSPROT; Acc: Q9Y3M8] | 13 | q13.1 |
| CaMax: 1110b | | | | | |
| CaMax: 1110b | | | | | |
| CaMax: 1111b | ENSG00000080546 | ENST00000302071 ENST00000237504 | SESTRIN 1 (P53-REGULATED PROTEIN PA26). [Source: SWISSPROT; Acc: Q9Y6P5] | 6 | q21 |

TABLE 2A-continued

| CaMax Gene ID | Ensemble Gene ID | Ensemble Transcript ID | Description | Chrom No. | Chrom Loc. |
|---|---|---|---|---|---|
| CaMax: 1112a | ENSG00000113391 | ENST00000265139 | | 5 | q15 |
| CaMax: 111a | | | | | |
| CaMax: 1120a | ENSG00000113384 | ENST00000265070 | GOLGI PHOSPHOPROTEIN 3; GOLGI PROTEIN; GOLGI PERIPHERAL MEMBRANE PROTEIN 1, 34 KDA; GOLGI-ASSOCIATED PROTEIN; COAT-PROTEIN. [Source: RefSeq; Acc: NM_022130] | 5 | p13.3 |
| CaMax: 1121a | ENSG00000185511 | ENST00000332847 | | 2 | p16.3 |
| CaMax: 1131b | | | | | |
| CaMax: 1132a | | | | | |
| CaMax: 1134a | ENSG00000081189 | ENST00000325423 | MYOCYTE-SPECIFIC ENHANCER FACTOR 2C. [Source: SWISSPROT; Acc: Q06413] | 5 | q14.3 |
| CaMax: 1135a | ENSG00000128573 | ENST00000324462 ENST00000265436 ENST00000324544 | FORKHEAD BOX PROTEIN P2 (CAG REPEAT PROTEIN 44) (TRINUCLEOTIDE REPEAT-CONTAINING GENE 10 PROTEIN). [Source: SWISSPROT; Acc: O15409] | 7 | q31.1 |
| CaMax: 1137b | | | | | |
| CaMax: 1138a | | | | | |
| CaMax: 1139a | | | | | |
| CaMax: 1145a | ENSG00000106817 | ENST00000311316 | COLLAGEN ALPHA 1(XV) CHAIN PRECURSOR. [Source: SWISSPROT; Acc: P39059] | 9 | q22.33 |
| CaMax: 1145a | | | | | |
| CaMax: 1146a | | | | | |
| CaMax: 1159b | | | | | |
| CaMax: 104a | ENSG00000169045 | ENST00000326748 ENST00000329433 | HETEROGENEOUS NUCLEAR RIBONUCLEOPROTEIN H (HNRNP H). [Source: SWISSPROT; Acc: P31943] | 5 | q35.3 |
| CaMax: 1169b | ENSG00000140416 | ENST00000267996 ENST00000334895 ENST00000288398 ENST00000317516 | TROPOMYOSIN 1 ALPHA CHAIN (ALPHA-TROPOMYOSIN). [Source: SWISSPROT; Acc: P09493] | 15 | q22.2 |
| CaMax: 1177c | ENSG00000100839 | ENST00000262237 | DYNEIN HEAVY CHAIN, CYTOSOLIC (DYHC) (CYTOPLASMIC DYNEIN HEAVY CHAIN 1) (DHC1) (FRAGMENT). [Source: SWISSPROT; Acc: Q14204] | 14 | q32.32 |
| CaMax: 1184a | ENSG00000156299 | ENST00000286827 | T-LYMPHOMA INVASION AND METASTASIS INDUCING PROTEIN 1 (TIAM1 PROTEIN). [Source: SWISSPROT; Acc: Q13009] | 21 | q22.11 |
| CaMax: 1184a | | | | | |
| CaMax: 1190b | ENSMUSG00000038954 | ENSMUST00000043985 ENSMUST00000050630 | | 17 | C |
| CaMax: 1192b | ENSMUSG00000038954 | ENSMUST00000043985 ENSMUST00000050630 | | 17 | C |
| CaMax: 11b | | | | | |
| CaMax: 120a | | | | | |
| CaMax: 120a | | | | | |
| CaMax: 1212b | | | | | |

TABLE 2A-continued

| CaMax Gene ID | Ensemble Gene ID | Ensemble Transcript ID | Description | Chrom No. | Chrom Loc. |
|---|---|---|---|---|---|
| CaMax: 1213d | ENSG00000134215 | ENST00000280840 | VAV-3 PROTEIN. [Source: SWISSPROT; Acc: Q9UKW4] | 1 | p13.3 |
| CaMax: 1217a | | | | | |
| CaMax: 1220b | | | | | |
| CaMax: 1226d | | | | | |
| CaMax: 1226d | | | | | |
| CaMax: 123c | | | | | |
| CaMax: 123c | | | | | |
| CaMax: 1243a | ENSG00000065183 | ENST00000183319 ENST00000309112 | WD-REPEAT PROTEIN 3. [Source: SWISSPROT; Acc: Q9UNX4] | 1 | p12 |
| CaMax: 1245b | | | | | |
| CaMax: 1246a | ENSG00000109775 | ENST00000264689 | | 4 | q35.1 |
| CaMax: 1248b | | | | | |
| CaMax: 1253a | ENSG00000109775 | ENST00000264689 | | 4 | q35.1 |
| CaMax: 1257b | | | | | |
| CaMax: 1257b | | | | | |
| CaMax: 1260c | | | | | |
| CaMax: 1263b | ENSMUSG00000045004 | ENSMUST00000051907 | | 4 | D3 |
| CaMax: 1267a | ENSG00000175198 | ENST00000310787 | PROPIONYL-COA CARBOXYLASE ALPHA CHAIN, MITOCHONDRIAL PRECURSOR (EC 6.4.1.3) (PCCASE ALPHA SUBUNIT) (PROPANOYL-COA: CARBON DIOXIDE LIGASE ALPHA SUBUNIT). [Source: SWISSPROT; Acc: P05165] | 13 | q32.3 |
| CaMax: 1267a | ENSG00000175198 | ENST00000310787 | PROPIONYL-COA CARBOXYLASE ALPHA CHAIN, MITOCHONDRIAL PRECURSOR (EC 6.4.1.3) (PCCASE ALPHA SUBUNIT) (PROPANOYL-COA: CARBON DIOXIDE LIGASE ALPHA SUBUNIT). [Source: SWISSPROT; Acc: P05165] | 13 | q32.3 |
| CaMax: 1270a | ENSG00000144331 | ENST00000272761 | | 2 | q31.2 |
| CaMax: 1272a | ENSG00000113615 | ENST00000265341 ENST00000322887 | PROTEIN TRANSPORT PROTEIN SEC24A (SEC24-RELATED PROTEIN A) (FRAGMENT). [Source: SWISSPROT; Acc: O95486] | 5 | q31.1 |
| CaMax: 1273b | | | | | |
| CaMax: 1276a | | | | | |
| CaMax: 127b | | | | | |
| CaMax: 127b | | | | | |
| CaMax: 1282b | | | | | |
| CaMax: 1284b | | | | | |
| CaMax: 1287c | ENSG00000164190 | ENST00000296607 ENST00000282516 | IDN3 PROTEIN ISOFORM A. [Source: RefSeq; Acc: NM_133433] | 5 | p13.2 |
| CaMax: 1288a | ENSG00000164190 | ENST00000296607 ENST00000282516 | IDN3 PROTEIN ISOFORM A. [Source: RefSeq; Acc: NM_133433] | 5 | p13.2 |

TABLE 2A-continued

| CaMax Gene ID | Ensemble Gene ID | Ensemble Transcript ID | Description | Chrom No. | Chrom Loc. |
|---|---|---|---|---|---|
| CaMax: 128a | ENSMUSG00000023944 | ENSMUST00000024739 | HEAT SHOCK PROTEIN HSP 90-BETA (HSP 84) (TUMOR SPECIFIC TRANSPLANTATION 84 KDA ANTIGEN) (TSTA). [Source: SWISSPROT; Acc: P11499] | 17 | C |
| CaMax: 1292c | ENSG00000079246 | ENST00000328063 | ATP-DEPENDENT DNA HELICASE II, 80 KDA SUBUNIT (LUPUS KU AUTOANTIGEN PROTEIN P86) (KU86) (KU80) (86 KDA SUBUNIT OF KU ANTIGEN) (THYROID-LUPUS AUTOANTIGEN) (TLAA) (CTC BOX BINDING FACTOR 85 KDA SUBUNIT) (CTCBF) (CTC85) (NUCLEAR FACTOR IV) (DNA-REPAIR PROTEIN XRCC5). [Source: SWISSPROT; Acc: P13010] | 2 | q35 |
| CaMax: 1294b | ENSG00000136628 | ENST00000259146 ENST00000335149 | BIFUNCTIONAL AMINOACYL-TRNA SYNTHETASE [INCLUDES: GLUTAMYL-TRNA SYNTHETASE (EC 6.1.1.17) (GLUTAMATE--TRNA LIGASE); PROLYL-TRNA SYNTHETASE (EC 6.1.1.15) (PROLINE--TRNA LIGASE)]. [Source: SWISSPROT; Acc: P07814] | 1 | q41 |
| CaMax: 1299c | ENSG00000163625 | ENST00000295888 ENST00000322366 | WD REPEAT AND FYVE DOMAIN CONTAINING 3 ISOFORM 1. [Source: RefSeq; Acc: NM_014991] | 4 | q21.23 |
| CaMax: 129b | | | | | |
| CaMax: 129b | | | | | |
| CaMax: 12a | | | | | |
| CaMax: 1301a | ENSMUSG00000049076 | ENSMUST00000058033 | | 16 | B2 |
| CaMax: 1304a | ENSG00000168952 | ENST00000323944 | AMISYN; SYNTAXIN BINDING PROTEIN 6. [Source: RefSeq; Acc: NM_014178] | 14 | q12 |
| CaMax: 1308c | | | | | |
| CaMax: 1308c | | | | | |
| CaMax: 130b | | | | | |
| CaMax: 1316b | | | | | |
| CaMax: 1318a | | | | | |
| CaMax: 1320 | | | | | |
| CaMax: 1322c | ENSRNOG00000003359 | | UDP-N-ACETYLGLUCOSAMINE--PEPTIDE N-ACETYLGLUCOSAMINYLTRANSFERASE 110 KDA SUBUNIT (EC 2.4.1.—) (O-GLCNAC TRANSFERASE P110 SUBUNIT). [Source: SWISSPROT; Acc: P56558] | 21 | q31 |
| CaMax: 1323br | | | | | |
| CaMax: 1323br | | | | | |
| CaMax: 1324a | | | | | |
| CaMax: 1324a | | | | | |
| CaMax: 1335b | | | | | |

TABLE 2A-continued

| CaMax Gene ID | Ensemble Gene ID | Ensemble Transcript ID | Description | Chrom No. | Chrom Loc. |
|---|---|---|---|---|---|
| CaMax: 1335b | | | | | |
| CaMax: 1341a | ENSG00000166923 | ENST00000300177<br>ENST00000322805 | CYSTEINE KNOT SUPERFAMILY 1, BMP ANTAGONIST 1; GREMLIN.<br>[Source: RefSeq; Acc: NM_013372] | 15 | q13.3 |
| CaMax: 1352b | | | | | |
| CaMax: 1354a | ENSG00000171567 | ENST00000304782 | TIGGER TRANSPOSABLE ELEMENT DERIVED 1; JERKY (MOUSE) HOMOLOG-LIKE.<br>[Source: RefSeq; Acc: NM_145702] | 2 | q37.1 |
| CaMax: 1355a | | | | | |
| CaMax: 1355a | | | | | |
| CaMax: 1361a | ENSG00000033170 | ENST00000315759<br>ENST00000261677 | ALPHA-(1,6)-FUCOSYLTRANSFERASE (EC 2.4.1.68) (GLYCOPROTEIN 6-ALPHA-L-FUCOSYLTRANSFERASE) (GDP-FUCOSE--GLYCOPROTEIN FUCOSYLTRANSFERASE) (GDP-L-FUC: N-ACETYL-BETA-D-GLUCOSAMINIDE ALPHA1,6-FUCOSYLTRANSFERASE) (ALPHA1-6FUCT) (FUCOSYLTRANSFERASE 8).<br>[Source: SWISSPROT; Acc: Q9BYC5] | 14 | q23.3 |
| CaMax: 1364d | | | | | |
| CaMax: 1364d | | | | | |
| CaMax: 1366a | ENSG00000064205 | ENST00000190983 | CONNECTIVE TISSUE GROWTH FACTOR-LIKE PROTEIN PRECURSOR (CTGF-L) (WNT1 INDUCIBLE SIGNALING PATHWAY PROTEIN 2) (WISP-2) (CONNECTIVE TISSUE GROWTH FACTOR-RELATED PROTEIN 58).<br>[Source: SWISSPROT; Acc: O76076] | 20 | q13.12 |
| CaMax: 1368a | ENSMUSG00000030871 | ENSMUST00000033159 | | 7 | F3 |
| CaMax: 1371a | ENSG00000119326 | ENST00000325551<br>ENST00000325580 | CATENIN (CADHERIN-ASSOCIATED PROTEIN), ALPHA-LIKE 1; ALPHA-CATULIN.<br>[Source: RefSeq; Acc: NM_003798] | 9 | q31.3 |
| CaMax: 137b | ENSG00000083771 | ENST00000218546 | M-PHASE PHOSPHOPROTEIN 8 (FRAGMENT).<br>[Source: SWISSPROT; Acc: Q99549] | 13 | q12.11 |
| CaMax: 1381a | | | | | |
| CaMax: 1381a | | | | | |
| CaMax: 1383a | ENSG00000067208 | ENST00000263785 | ECOTROPIC VIRAL INTEGRATION SITE 5; NEUROBLASTOMA STAGE 4S GENE.<br>[Source: RefSeq; Acc: NM_005665] | 1 | p22.1 |
| CaMax: 1384a | ENSG00000099194 | ENST00000266053 | ACYL-COA DESATURASE (EC 1.14.19.1) (STEAROYL-COA DESATURASE) (FATTY ACID DESATURASE) (DELTA(9)-DESATURASE).<br>[Source: SWISSPROT; Acc: O00767] | 10 | q24.31 |
| CaMax: 1391a | | | | | |

TABLE 2A-continued

| CaMax Gene ID | Ensemble Gene ID | Ensemble Transcript ID | Description | Chrom No. | Chrom Loc. |
|---|---|---|---|---|---|
| CaMax: 1394b | | | | | |
| CaMax: 1397b | ENSG00000111912 | ENST00000229634 ENST00000318575 | NUCLEAR RECEPTOR COACTIVATOR 7; ESTROGEN RECEPTOR ASSOCIATED PROTEIN 140 KDA. [Source: RefSeq; Acc: NM_181782] | 6 | q22.32 |
| CaMax: 1399a | | | | | |
| CaMax: 13a | | | | | |
| CaMax: 1400a | | | | | |
| CaMax: 1401c | ENSG00000109756 | ENST00000264431 | PDZ DOMAIN CONTAINING GUANINE NUCLEOTIDE EXCHANGE FACTOR (GEF) 1; RA(RAS/RAP1A-ASSOCIATING)-GEF; PDZ DOMAIN CONTAINING GUANINE NUCLEOTIDE EXCHANGE FACTOR(GEF)1; RA(RAS/RAP1A-ASSOCIATING)-GEF; PDZ DOMAIN CONTAINING GUANINE NUCLEOTIDE EXCHANGE FACTOR(GEF)1. [Source: RefSeq; Acc: NM_014247] | 4 | q32.1 |
| CaMax: 1403a | | | | | |
| CaMax: 1406a | | | | | |
| CaMax: 1409b | ENSG00000166170 | ENST00000299204 | BAG-FAMILY MOLECULAR CHAPERONE REGULATOR-5 (BAG-5). [Source: SWISSPROT; Acc: Q9UL15] | 14 | q32.32 |
| CaMax: 1411a | ENSG00000058272 | ENST00000261207 ENST00000312727 | PROTEIN PHOSPHATASE 1, REGULATORY (INHIBITOR) SUBUNIT 12A; MYOSIN PHOSPHATASE, TARGET SUBUNIT 1. [Source: RefSeq; Acc: NM_002480] | 12 | q21.2 |
| CaMax: 1415b | ENSMUSG00000034794 | ENSMUST00000054209 ENSMUST00000046558 | | 4 | C7 |
| CaMax: 1416a | | | | | |
| CaMax: 1419a | | | | | |
| CaMax: 141c | | | | | |
| CaMax: 141c | | | | | |
| CaMax: 142.1c | | | | | |
| CaMax: 142.1c | | | | | |
| CaMax: 1420c | ENSG00000128845 | ENST00000267809 ENST00000310958 | CELL CYCLE PROGRESSION 8 PROTEIN. [Source: RefSeq; Acc: NM_020739] | 15 | q21.3 |
| CaMax: 1421a | ENSG00000172175 | ENST00000313958 ENST00000303708 | MUCOSA ASSOCIATED LYMPHOID TISSUE LYMPHOMA TRANSLOCATION PROTEIN 1 (EC 3.4.22.—) (MALT-LYMPHOMA ASSOCIATED TRANSLOCATION) (PARACASPASE). [Source: SWISSPROT; Acc: Q9UDY8] | 18 | q21.31 |
| CaMax: 1423b | | | | | |
| CaMax: 143.2c | ENSG00000152583 | ENST00000282470 | SPARC-LIKE PROTEIN 1 PRECURSOR (HIGH ENDOTHELIAL VENULE PROTEIN) (HEVIN) (MAST 9). [Source: SWISSPROT; Acc: Q14515] | 4 | q22.1 |

TABLE 2A-continued

| CaMax Gene ID | Ensemble Gene ID | Ensemble Transcript ID | Description | Chrom No. | Chrom Loc. |
|---|---|---|---|---|---|
| CaMax: 143.2c | ENSG00000152583 | ENST00000282470 | SPARC-LIKE PROTEIN 1 PRECURSOR (HIGH ENDOTHELIAL VENULE PROTEIN) (HEVIN) (MAST 9). [Source: SWISSPROT; Acc: Q14515] | 4 | q22.1 |
| CaMax: 1431a | | | | | |
| CaMax: 144.2a | | | | | |
| CaMax: 144.2a | | | | | |
| CaMax: 1448a | ENSG00000154430 | ENST00000284618 | TESTICAN-3 PRECURSOR. [Source: SWISSPROT; Acc: Q9BQ16] | 4 | q32.3 |
| CaMax: 1449a | ENSG00000170631 | ENST00000276816 ENST00000317284 ENST00000332620 ENST00000317099 ENST00000333589 ENST00000276823 ENST00000332158 ENST00000292579 ENST00000331465 | ZINC FINGER PROTEIN CLONE 647. [Source: SWISSPROT; Acc: P15622] | 8 | q24.3 |
| CaMax: 1450a | ENSG00000170891 | ENST00000307746 | CYTOKINE-LIKE PROTEIN C17 PRECURSOR. [Source: SWISSPROT; Acc: Q9NRR1] | 4 | p16.2 |
| CaMax: 1452a | | | | | |
| CaMax: 1457b | | | | | |
| CaMax: 1459c | ENSG00000113387 | ENST00000265073 | ACTIVATED RNA POLYMERASE II TRANSCRIPTIONAL COACTIVATOR P15 (PC4) (P14). [Source: SWISSPROT; Acc: P53999] | 5 | p13.3 |
| CaMax: 1459c | | | | | |
| CaMax: 145b | ENSG00000147403 | ENST00000276371 | 60S RIBOSOMAL PROTEIN L10 (QM PROTEIN) (TUMOR SUPPRESSOR QM) (LAMININ RECEPTOR HOMOLOG). [Source: SWISSPROT; Acc: P27635] | 24 | q28 |
| CaMax: 1460a | | | | | |
| CaMax: 1460a | | | | | |
| CaMax: 1461a | | | | | |
| CaMax: 1461a | | | | | |
| CaMax: 1466b | | | | | |
| CaMax: 1466b | | | | | |
| CaMax: 1469a | ENSMUSG00000046599 | ENSMUST00000060592 | UPREGULATED DURING SKELETAL MUSCLE GROWTH 5. [Source: RefSeq; Acc: NM_023211] | 20 | A2 |
| CaMax: 146b | ENSG00000112365 | ENST00000230122 | | 6 | q21 |
| CaMax: 1469a | ENSMUSG00000046599 | ENSMUST00000060592 | UPREGULATED DURING SKELETAL MUSCLE GROWTH 5. [Source: RefSeq; Acc: NM_023211] | 20 | A2 |
| CaMax: 1472a | | | | | |
| CaMax: 1475a | | | | | |
| CaMax: 1476a | ENSG00000172201 | ENST00000326913 | DNA-BINDING PROTEIN INHIBITOR ID-4. [Source: SWISSPROT; Acc: P47928] | 6 | p22.3 |

TABLE 2A-continued

| CaMax Gene ID | Ensemble Gene ID | Ensemble Transcript ID | Description | Chrom No. | Chrom Loc. |
|---|---|---|---|---|---|
| CaMax: 1477a | ENSG00000159388 | ENST00000290551 | BTG2 PROTEIN (NGF-INDUCIBLE ANTI-PROLIFERATIVE PROTEIN PC3). [Source: SWISSPROT; Acc: P78543] | 1 | q32.1 |
| CaMax: 147b | | | | | |
| CaMax: 1481c | ENSG00000105997 | ENST00000317201 | HOMEOBOX PROTEIN HOX-A3 (HOX-1E). [Source: SWISSPROT; Acc: O43365] | 7 | p15.2 |
| CaMax: 1482a | ENSG00000115998 | ENST00000264434 | | 2 | p13.3 |
| CaMax: 1484b | | | | | |
| CaMax: 1488b | ENSG00000122566 | ENST00000265398 ENST00000312091 | HETEROGENEOUS NUCLEAR RIBONUCLEOPROTEINS A2/B1 (HNRNP A2/HNRNP B1). [Source: SWISSPROT; Acc: P22626] | 7 | p15.2 |
| CaMax: 148a | | | | | |
| CaMax: 1497c | | | | | |
| CaMax: 1497c | | | | | |
| CaMax: 1500b | | | | | |
| CaMax: 1504d | | | | | |
| CaMax: 1506d | | | | | |
| CaMax: 1506d | | | | | |
| CaMax: 150a | ENSG00000106853 | ENST00000333580 ENST00000309195 | NADP-DEPENDENT LEUKOTRIENE B4 12-HYDROXYDEHYDROGENASE (EC 1.1.1.—). [Source: SWISSPROT; Acc: Q14914] | 9 | q31.3 |
| CaMax: 1516a | ENSG00000115998 | ENST00000264434 | | 2 | p13.3 |
| CaMax: 1519a | | | | | |
| CaMax: 1519a | | | | | |
| CaMax: 151b | | | | | |
| CaMax: 1520a | | | | | |
| CaMax: 1520a | | | | | |
| CaMax: 1521b | ENSG00000165421 | ENST00000333218 ENST00000327431 ENST00000328257 | PROTEIN PHOSPHATASE METHYLESTERASE-1. [Source: RefSeq; Acc: NM_016147] | 11 | q13.4 |
| CaMax: 1522b | | | | | |
| CaMax: 1531c | | | | | |
| CaMax: 1532a | | | | | |
| CaMax: 1532a | | | | | |
| CaMax: 1534b | ENSG00000133637 | ENST00000309041 ENST00000322687 ENST00000256013 | | 12 | q21.32 |
| CaMax: 1534b | | | | | |
| CaMax: 1535a | | | | | |
| CaMax: 1541a | | | | | |
| CaMax: 1546b | ENSG00000151012 | ENST00000280612 | CYSTINE/GLUTAMATE TRANSPORTER (AMINO ACID TRANSPORT SYSTEM XC-) (XCT) (CALCIUM CHANNEL BLOCKER | 4 | q28.3 |

TABLE 2A-continued

| CaMax Gene ID | Ensemble Gene ID | Ensemble Transcript ID | Description | Chrom No. | Chrom Loc. |
|---|---|---|---|---|---|
| | | | RESISTANCE PROTEIN CCBR1). [Source: SWISSPROT; Acc: Q9UPY5] | | |
| CaMax: 1548c | | | | | |
| CaMax: 1549a | | | | | |
| CaMax: 1551a | ENSG00000179454 | ENST00000324772 | BTB (POZ) DOMAIN CONTAINING 5. [Source: RefSeq; Acc: NM_017658] | 14 | q21.2 |
| CaMax: 1554c | | | | | |
| CaMax: 1573a | ENSG00000178074 | ENST00000319974 | | 2 | q33.1 |
| CaMax: 1574b | | | | | |
| CaMax: 1574b | | | | | |
| CaMax: 1577a | ENSG00000144785 | ENST00000273308 | TRANSMEMBRANE PROTEIN 4. [Source: RefSeq; Acc: NM_014255] | 12 | q13.3 |
| CaMax: 1578a | | | | | |
| CaMax: 157b | | | | | |
| CaMax: 157b | | | | | |
| CaMax: 1591a | | | | | |
| CaMax: 1591a | | | | | |
| CaMax: 1594a | | | | | |
| CaMax: 1596b | | | | | |
| CaMax: 1596b | | | | | |
| CaMax: 1598a | | | | | |
| CaMax: 159a | | | | | |
| CaMax: 159a | | | | | |
| CaMax: 15b | ENSG00000174132 | ENST00000312637 | | 5 | q21.1 |
| CaMax: 1602a | ENSG00000113838 | ENST00000265025 | | 3 | q27.3 |
| CaMax: 1604a | | | | | |
| CaMax: 1626c | ENSG00000183456 | ENST00000330170 | | 2 | q33.1 |
| CaMax: 1628d | | | | | |
| CaMax: 1629a | | | | | |
| CaMax: 1629a | | | | | |
| CaMax: 1630b | | | | | |
| CaMax: 1630b | | | | | |
| CaMax: 1631d | ENSG00000083290 | ENST00000261504 | UNC-51-LIKE KINASE 2. [Source: RefSeq; Acc: NM_014683] | 17 | p11.2 |
| CaMax: 1635a | ENSG00000083290 | ENST00000261504 | UNC-51-LIKE KINASE 2. [Source: RefSeq; Acc: NM_014683] | 17 | p11.2 |
| CaMax: 1635a | ENSG00000083290 | ENST00000261504 | UNC-51-LIKE KINASE 2. [Source: RefSeq; Acc: NM_014683] | 17 | p11.2 |
| CaMax: 1639a | | | | | |
| CaMax: 1639a | | | | | |
| CaMax: 163a | ENSG00000006015 | ENST00000326666 ENST00000326636 | | 19 | p13.11 |
| CaMax: 1646a | ENSG00000120254 | ENST00000265365 | | 6 | q25.1 |
| CaMax: 1648a | ENSMUSG00000033207 | ENSMUST00000036069 | | 19 | C1 |

TABLE 2A-continued

| CaMax Gene ID | Ensemble Gene ID | Ensemble Transcript ID | Description | Chrom No. | Chrom Loc. |
|---|---|---|---|---|---|
| CaMax: 164c | ENSG00000163734 | ENST00000296026 | MACROPHAGE INFLAMMATORY PROTEIN-2-BETA PRECURSOR (MIP2-BETA) (CXCL3) (GROWTH REGULATED PROTEIN GAMMA) (GRO-GAMMA). [Source: SWISSPROT; Acc: P19876] | 4 | q13.3 |
| CaMax: 1659a | | | | | |
| CaMax: 1659a | | | | | |
| CaMax: 166a | ENSG00000162384 | ENST00000294360 | | 1 | p32.3 |
| CaMax: 1671b | | | | | |
| CaMax: 1671b | | | | | |
| CaMax: 1675a | | | | | |
| CaMax: 1676a | | | | | |
| CaMax: 1676a | | | | | |
| CaMax: 1678a | | | | | |
| CaMax: 1682a | | | | | |
| CaMax: 168c | | | | | |
| CaMax: 1690a | ENSRNOG00000017817 | | CYTOCHROME C OXIDASE SUBUNIT IV ISOFORM 1, MITOCHONDRIAL PRECURSOR (EC 1.9.3.1) (COX IV-1) (CYTOCHROME C OXIDASE POLYPEPTIDE IV). [Source: SWISSPROT; Acc: P10888] | 19 | q12 |
| CaMax: 1691b | ENSG00000081177 | ENST00000193422 | | 14 | q24.1 |
| CaMax: 1692a | ENSRNOG00000017817 | | CYTOCHROME C OXIDASE SUBUNIT IV ISOFORM 1, MITOCHONDRIAL PRECURSOR (EC 1.9.3.1) (COX IV-1) (CYTOCHROME C OXIDASE POLYPEPTIDE IV). [Source: SWISSPROT; Acc: P10888] | 19 | q12 |
| CaMax: 1693b | ENSG00000066468 | ENST00000263455 ENST00000310977 ENST00000263451 ENST00000263454 ENST00000328075 ENST00000310973 ENST00000263453 ENST00000332961 | FIBROBLAST GROWTH FACTOR RECEPTOR 2 PRECURSOR (EC 2.7.1.112) (FGFR-2) (KERATINOCYTE GROWTH FACTOR RECEPTOR 2). [Source: SWISSPROT; Acc: P21802] | 10 | q26.13 |
| CaMax: 1696a | | | | | |
| CaMax: 1696a | | | | | |
| CaMax: 16b | | | | | |
| CaMax: 1705a | ENSG00000132357 | ENST00000254691 | CASPASE RECRUITMENT DOMAIN PROTEIN 6. [Source: SWISSPROT; Acc: Q9BX69] | 5 | p13.1 |
| CaMax: 1709a | | | | | |
| CaMax: 1714a | ENSG00000033178 | ENST00000322244 | | 4 | q13.2 |
| CaMax: 1715a | | | | | |
| CaMax: 1717a | ENSG00000179010 | ENST00000320912 | T-CELL ACTIVATION PROTEIN. [Source: RefSeq; Acc: NM_033296] | 4 | p16.1 |

TABLE 2A-continued

| CaMax Gene ID | Ensemble Gene ID | Ensemble Transcript ID | Description | Chrom No. | Chrom Loc. |
|---|---|---|---|---|---|
| CaMax: 1721a | ENSG00000021355 | ENST00000229479 | LEUKOCYTE ELASTASE INHIBITOR (LEI) (MONOCYTE/NEUTROPHIL ELASTASE INHIBITOR) (M/NEI) (EI). [Source: SWISSPROT; Acc: P30740] | 6 | p25.2 |
| CaMax: 1722a | ENSG00000144674 | ENST00000273176 | GOLGI AUTOANTIGEN, GOLGIN SUBFAMILY A MEMBER 4 (TRANS-GOLGI P230) (256 KDA GOLGIN) (GOLGIN-245) (72.1 PROTEIN). [Source: SWISSPROT; Acc: Q13439] | 3 | p22.3 |
| CaMax: 1724a | ENSG00000143147 | ENST00000271357 | G-PROTEIN COUPLED RECEPTOR. [Source: RefSeq; Acc: NM_153832] | 1 | q24.2 |
| CaMax: 1725a | | | | | |
| CaMax: 1726a | | | | | |
| CaMax: 1726a | | | | | |
| CaMax: 1727a | ENSG00000131355 | ENST00000253673 | EGF-LIKE MODULE-CONTAINING MUCIN-LIKE RECEPTOR 3 ISOFORM A. [Source: RefSeq; Acc: NM_032571] | 19 | p13.12 |
| CaMax: 1730a | | | | | |
| CaMax: 1738b | | | | | |
| CaMax: 1741a | | | | | |
| CaMax: 1744a | ENSG00000109883 | ENST00000227288 | LEUCINE-RICH REPEAT-CONTAINING G PROTEIN-COUPLED RECEPTOR 4 PRECURSOR (G PROTEIN-COUPLED RECEPTOR 48). [Source: SWISSPROT; Acc: Q9BXB1] | 11 | p14.1 |
| CaMax: 1744a | | | | | |
| CaMax: 174a | ENSG00000139688 | ENST00000267164 | TRANSCRIPTION INITIATION FACTOR IIF, BETA SUBUNIT (TFIIF-BETA) (TRANSCRIPTION INITIATION FACTOR RAP30). [Source: SWISSPROT; Acc: P13984] | 13 | q14.12 |
| CaMax: 174a | | | | | |
| CaMax: 1750a | | | | | |
| CaMax: 1751a | | | | | |
| CaMax: 1755a | | | | | |
| CaMax: 1755a | | | | | |
| CaMax: 1758a | ENSG00000104852 | ENST00000221448 | U1 SMALL NUCLEAR RIBONUCLEOPROTEIN 70 KDA (U1 SNRNP 70 KDA) (SNRNP70) (U1-70K). [Source: SWISSPROT; Acc: P08621] | 19 | q13.33 |
| CaMax: 1759b | ENSG00000179454 | ENST00000324772 | BTB (POZ) DOMAIN CONTAINING 5. [Source: RefSeq; Acc: NM_017658] | 14 | q21.2 |
| CaMax: 1760c | | | | | |
| CaMax: 1760c | | | | | |
| CaMax: 1772a | | | | | |
| CaMax: 1775a | ENSG00000179562 | ENST00000321407 | GOLGI COILED COIL PROTEIN 1. [Source: SWISSPROT; Acc: Q96CN9] | 7 | q32.1 |
| CaMax: 1775a | ENSG00000179562 | ENST00000321407 | GOLGI COILED COIL PROTEIN 1. [Source: SWISSPROT; Acc: Q96CN9] | 7 | q32.1 |

TABLE 2A-continued

| CaMax Gene ID | Ensemble Gene ID | Ensemble Transcript ID | Description | Chrom No. | Chrom Loc. |
|---|---|---|---|---|---|
| CaMax: 1778c | | | | | |
| CaMax: 1782b | ENSG00000184880 | ENST00000332933 | OK/SW-CL.87. [Source: SPTREMBL; Acc: Q8NI68] | 11 | q23.3 |
| CaMax: 178a | ENSG00000135457 | ENST00000257915 ENST00000307660 | TRANSCRIPTION FACTOR CP2; TRANSCRIPTION FACTOR CP2, ALPHA GLOBIN. [Source: RefSeq; Acc: NM_005653] | 12 | q13.12 |
| CaMax: 1794a | | | | | |
| CaMax: 1794a | | | | | |
| CaMax: 17a | | | | | |
| CaMax: 1800a | | | | | |
| CaMax: 1801b | ENSG00000166855 | ENST00000300107 | ATP-DEPENDENT CLP PROTEASE ATP-BINDING SUBUNIT CLPX-LIKE, MITOCHONDRIAL PRECURSOR. [Source: SWISSPROT; Acc: O76031] | 15 | q22.31 |
| CaMax: 180a | ENSG00000171567 | ENST00000304782 | TIGGER TRANSPOSABLE ELEMENT DERIVED 1; JERKY (MOUSE) HOMOLOG-LIKE. [Source: RefSeq; Acc: NM_145702] | 2 | q37.1 |
| CaMax: 1810a | ENSG00000102901 | ENST00000219172 | | 16 | q22.1 |
| CaMax: 1811b | | | | | |
| CaMax: 1812b | ENSG00000105492 | ENST00000270604 | SIALIC ACID BINDING IG-LIKE LECTIN 6 PRECURSOR (SIGLEC-6) (OBESITY-BINDING PROTEIN 1) (OB-BP1) (CD33 ANTIGEN-LIKE 1). [Source: SWISSPROT; Acc: O43699] | 19 | q13.41 |
| CaMax: 1814c | ENSG00000145730 | ENST00000304400 ENST00000304406 ENST00000282992 ENST00000325306 ENST00000274392 | PEPTIDYL-GLYCINE ALPHA-AMIDATING MONOOXYGENASE PRECURSOR (EC 1.14.17.3) (PAM). [Source: SWISSPROT; Acc: P19021] | 5 | q21.1 |
| CaMax: 1814c | | | | | |
| CaMax: 1818a | | | | | |
| CaMax: 1828b | ENSMUSG00000021613 | ENSMUST00000053227 ENSMUST00000022108 | PROTEOGLYCAN LINK PROTEIN PRECURSOR (CARTILAGE LINK PROTEIN) (LP). [Source: SWISSPROT; Acc: Q9QUP5] | 13 | C3 |
| CaMax: 1834b | | | | | |
| CaMax: 1849d | | | | | |
| CaMax: 1852a | | | | | |
| CaMax: 1853a | ENSRNOG00000013516 | | SPLICEOSOMAL PROTEIN SAP155 (FRAGMENT). [Source: SPTREMBL; Acc: Q9ET34] | 9 | q31 |
| CaMax: 1857c | ENSRNOG00000015205 | | CYTOCHROME B5. [Source: SWISSPROT; Acc: P00173] | 18 | q12.3 |
| CaMax: 1859a | ENSG00000055609 | ENST00000312661 ENST00000262189 | MYELOID/LYMPHOID OR MIXED-LINEAGE LEUKEMIA 3; ALR-LIKE PROTEIN. [Source: RefSeq; Acc: NM_021230] | 7 | q36.1 |
| CaMax: 1863c | | | | | |
| CaMax: 1863c | | | | | |
| CaMax: 1864b | ENSMUSG00000033732 | ENSMUST00000042012 ENSMUST00000054613 | | 8 | D3 |

TABLE 2A-continued

| CaMax Gene ID | Ensemble Gene ID | Ensemble Transcript ID | Description | Chrom No. | Chrom Loc. |
|---|---|---|---|---|---|
| CaMax: 186a | ENSG00000173210 | ENST00000309868 ENST00000326685 | | 5 | q33.1 |
| CaMax: 1874b | | | | | |
| CaMax: 1874b | | | | | |
| CaMax: 1879a | | | | | |
| CaMax: 1879a | | | | | |
| CaMax: 1881b | | | | | |
| CaMax: 1894a | ENSG00000151806 | ENST00000281543 | | 4 | p13 |
| CaMax: 18a | | | | | |
| CaMax: 1912a | | | | | |
| CaMax: 1912a | | | | | |
| CaMax: 1913a | | | | | |
| CaMax: 1913a | | | | | |
| CaMax: 1917f | ENSG00000146414 | ENST00000275233 ENST00000334592 | SNF2 HISTONE LINKER PHD RING HELICASE. [Source: RefSeq; Acc: NM_173082] | 6 | q24.3 |
| CaMax: 1919a | ENSG00000057019 | ENST00000326857 ENST00000326840 | ENDOTHELIAL AND SMOOTH MUSCLE CELL-DERIVED NEUROPILIN-LIKE PROTEIN; COAGULATION FACTOR V/VIII-HOMOLOGY DOMAINS PROTEIN 1. [Source: RefSeq; Acc: NM_080927] | 3 | q12.1 |
| CaMax: 1920a | ENSMUSG00000022649 | ENSMUST00000052314 ENSMUST00000023327 | | 16 | B5 |
| CaMax: 1928a | | | | | |
| CaMax: 1929c | ENSG00000142207 | ENST00000270201 | | 21 | q22.11 |
| CaMax: 1930a | ENSG00000117868 | ENST00000251527 | | 7 | q36.3 |
| CaMax: 1940e | ENSG00000116957 | ENST00000264180 | BETA-TUBULIN COFACTOR E. [Source: RefSeq; Acc: NM_003193] | 1 | q42.3 |
| CaMax: 1941e | ENSG00000070214 | ENST00000185520 | CDW92 ANTIGEN; CHOLINE TRANSPORTER-LIKE PROTEIN. [Source: RefSeq; Acc: NM_080546] | 9 | q31.1 |
| CaMax: 1943a | ENSG00000154553 | ENST00000284770 ENST00000284771 ENST00000284767 | ALPHA-ACTININ-2-ASSOCIATED LIM PROTEIN; ENIGMA HOMOLOG. [Source: RefSeq; Acc: NM_014476] | 4 | q35.1 |
| CaMax: 1944a | | | | | |
| CaMax: 1944a | | | | | |
| CaMax: 1945a | | | | | |
| CaMax: 1945a | | | | | |
| CaMax: 1948b | | | | | |
| CaMax: 1948b | | | | | |
| CaMax: 1949a | | | | | |
| CaMax: 1949a | | | | | |
| CaMax: 1950a | ENSG00000134215 | ENST00000280840 | VAV-3 PROTEIN. [Source: SWISSPROT; Acc: Q9UKW4] | 1 | p13.3 |
| CaMax: 1953a | ENSG00000138386 | ENST00000321041 | NGFI-A BINDING PROTEIN 1 (EGR-1 BINDING PROTEIN 1) (TRANSCRIPTIONAL | 2 | q32.2 |

TABLE 2A-continued

| CaMax Gene ID | Ensemble Gene ID | Ensemble Transcript ID | Description | Chrom No. | Chrom Loc. |
|---|---|---|---|---|---|
| | | | REGULATORY PROTEIN P54). [Source: SWISSPROT; Acc: Q13506] | | |
| CaMax: 1954e | | | | | |
| CaMax: 1961e | ENSG00000157077 | ENST00000287722 ENST00000287727 | MOTHERS AGAINST DECAPENTAPLEGIC HOMOLOG INTERACTING PROTEIN (MADH-INTERACTING PROTEIN) (SMAD ANCHOR FOR RECEPTOR ACTIVATION) (RECEPTOR ACTIVATION ANCHOR) (HSARA) (NOVEL SERINE PROTEASE) (NSP). [Source: SWISSPROT; Acc: O95405] | 1 | p32.3 |
| CaMax: 1967a | ENSG00000080469 | ENST00000328494 ENST00000190846 | ANTIGEN PEPTIDE TRANSPORTER 2 (APT2) (PEPTIDE TRANSPORTER TAP2) (PEPTIDE TRANSPORTER PSF2) (PEPTIDE SUPPLY FACTOR 2) (PSF-2) (PEPTIDE TRANSPORTER INVOLVED IN ANTIGEN PROCESSING 2). [Source: SWISSPROT; Acc: Q03519] | 6 | p21.32 |
| CaMax: 1968a | ENSG00000138063 | ENST00000260632 | PELLINO PROTEIN. [Source: RefSeq; Acc: NM_020651] | 2 | p14 |
| CaMax: 1982a | ENSG00000060718 | ENST00000305302 ENST00000193186 ENST00000314022 ENST00000305262 | COLLAGEN ALPHA 1 (XI) CHAIN PRECURSOR. [Source: SWISSPROT; Acc: P12107] | 1 | p21.1 |
| CaMax: 1989b | | | | | |
| CaMax: 1990a | ENSG00000166974 | ENST00000300249 | MICROTUBULE-ASSOCIATED PROTEIN, RP/EB FAMILY, MEMBER 2; T-CELL ACTIVATION PROTEIN, EB1 FAMILY; APC-BINDING PROTEIN EB1. [Source: RefSeq; Acc: NM_014268] | 18 | q12.1 |
| CaMax: 1991d | | | | | |
| CaMax: 1a | | | | | |
| CaMax: 2002c | | | | | |
| CaMax: 2003a | ENSG00000081019 | ENST00000261441 | | 1 | p13.2 |
| CaMax: 2008a | ENSMUSG00000027883 | ENSMUST00000029482 | PINS. [Source: RefSeq; Acc: NM_029522] | 3 | F3 |
| CaMax: 2013a | ENSG00000180530 | ENST00000318948 | NUCLEAR FACTOR RIP140 (NUCLEAR RECEPTOR INTERACTING PROTEIN 1). [Source: SWISSPROT; Acc: P48552] | 21 | q11.2 |
| CaMax: 2014f | | | | | |
| CaMax: 2015e | ENSG00000174444 | ENST00000307961 | 60S RIBOSOMAL PROTEIN L4 (L1). [Source: SWISSPROT; Acc: P36578] | 15 | q22.31 |
| CaMax: 2020b | ENSG00000011566 | ENST00000263881 | MITOGEN-ACTIVATED PROTEIN KINASE KINASE KINASE 3 (EC 2.7.1.37) (MAPK/ERK KINASE KINASE KINASE 3) (MEK KINASE KINASE 3) (MEKKK 3) (GERMINAL CENTER KINASE RELATED PROTEIN KINASE) (GLK). [Source: SWISSPROT; Acc: Q8IVH8] | 2 | p22.1 |
| CaMax: 2020b | | | | | |
| CaMax: 2022a | ENSG00000020577 | ENST00000305831 ENST00000251091 ENST00000321411 | | 14 | q22.2 |

TABLE 2A-continued

| CaMax Gene ID | Ensemble Gene ID | Ensemble Transcript ID | Description | Chrom No. | Chrom Loc. |
|---|---|---|---|---|---|
| CaMax: 2023b | | | | | |
| CaMax: 2023b | | | | | |
| CaMax: 2024a | | | | | |
| CaMax: 2034a | ENSG00000172155 | ENST00000326233 | LATE ENVELOPE PROTEIN 4. [Source: RefSeq; Acc: NM_178352] | 1 | q21.3 |
| CaMax: 2035d | ENSG00000161980 | ENST00000293860 | DNA-DIRECTED RNA POLYMERASES III 12.5 KDA POLYPEPTIDE (EC 2.7.7.6) (RNA POLYMERASE III C11 SUBUNIT) (HSC11P) (HRPC11) (MY010 PROTEIN). [Source: SWISSPROT; Acc: Q9Y2Y1] | 16 | p13.3 |
| CaMax: 204a | | | | | |
| CaMax: 2056d | ENSG00000141331 | ENST00000269073 | POTENTIAL HELICASE WITH ZINC-FINGER DOMAIN. [Source: SWISSPROT; Acc: P42694] | 17 | q24.2 |
| CaMax: 2059b | | | | | |
| CaMax: 205a | | | | | |
| CaMax: 2070a | ENSG00000129116 | ENST00000261509 ENST00000335213 ENST00000333488 | PALLADIN; CGI-151 PROTEIN. [Source: RefSeq; Acc: NM_016081] | 4 | q32.3 |
| CaMax: 2073b | | | | | |
| CaMax: 2073b | | | | | |
| CaMax: 2074b | ENSG00000124406 | ENST00000264449 | POTENTIAL PHOSPHOLIPID-TRANSPORTING ATPASE IA (EC 3.6.3.1) (CHROMAFFIN GRANULE ATPASE II) (ATPASE CLASS I TYPE 8A MEMBER 1). [Source: SWISSPROT; Acc: Q9Y2Q0] | 4 | p13 |
| CaMax: 2075a | ENSG00000138709 | ENST00000264584 ENST00000326703 ENST00000326639 | | 4 | q28.2 |
| CaMax: 2076c | | | | | |
| CaMax: 2078a | ENSG00000122545 | ENST00000322406 | SEPTIN 7 (CDC10 PROTEIN HOMOLOG). [Source: SWISSPROT; Acc: Q16181] | 7 | p14.2 |
| CaMax: 2083e | ENSG00000085449 | ENST00000233055 ENST00000272881 | WD REPEAT AND FYVE DOMAIN CONTAINING 1 ISOFORM 1; PHOSPHOINOSITIDE-BINDING PROTEIN SR1; WD40 AND FYVE DOMAIN CONTAINING 1. [Source: RefSeq; Acc: NM_020830] | 2 | q36.1 |
| CaMax: 2088a | ENSG00000152487 | ENST00000302150 | | 10 | p12.31 |
| CaMax: 2092c | | | | | |
| CaMax: 2095a | | | | | |
| CaMax: 2099a | | | | | |
| CaMax: 2099a | | | | | |
| CaMax: 20a | | | | | |
| CaMax: 20a | | | | | |
| CaMax: 2100b | ENSG00000166147 | ENST00000316623 | FIBRILLIN 1 PRECURSOR. [Source: SWISSPROT; Acc: P35555] | 15 | q21.1 |
| CaMax: 2105a | | | | | |

TABLE 2A-continued

| CaMax Gene ID | Ensemble Gene ID | Ensemble Transcript ID | Description | Chrom No. | Chrom Loc. |
|---|---|---|---|---|---|
| CaMax: 2108b | | | | | |
| CaMax: 2109a | | | | | |
| CaMax: 2110a | ENSG00000180837 | ENST00000318177 | ZINC FINGER PROTEIN 345 (ZINC FINGER PROTEIN HZF10). [Source: SWISSPROT; Acc: Q14585] | 19 | q13.12 |
| CaMax: 2113a | | | | | |
| CaMax: 211b | ENSG00000103222 | ENST00000263013 ENST00000263018 ENST00000263015 ENST00000263019 ENST00000263017 ENST00000263014 ENST00000263016 | MULTIDRUG RESISTANCE-ASSOCIATED PROTEIN 1. [Source: SWISSPROT; Acc: P33527] | 16 | p13.11 |
| CaMax: 2122a | | | | | |
| CaMax: 2123a | ENSG00000139370 | ENST00000266771 | PEPTIDE-HISTIDINE TRANSPORTER 4. [Source: RefSeq; Acc: NM_145648] | 12 | q24.32 |
| CaMax: 2129a | ENSG00000143415 | ENST00000271682 | SMALL PROTEIN EFFECTOR 1 OF CDC42. [Source: RefSeq; Acc: NM_020239] | 1 | q21.3 |
| CaMax: 2132a | | | | | |
| CaMax: 2135d | | | | | |
| CaMax: 2136b | | | | | |
| CaMax: 2141a | | | | | |
| CaMax: 2142a | | | | | |
| CaMax: 2160a | | | | | |
| CaMax: 2161c | ENSG00000138709 | ENST00000264584 ENST00000326703 ENST00000326639 | | 4 | q28.2 |
| CaMax: 2165a | | | | | |
| CaMax: 2167a | | | | | |
| CaMax: 2189b | | | | | |
| CaMax: 2198b | | | | | |
| CaMax: 2201a | | | | | |
| CaMax: 2201a | | | | | |
| CaMax: 2205a | | | | | |
| CaMax: 2210a | | | | | |
| CaMax: 2222b | ENSG00000117868 | ENST00000251527 | | 7 | q36.3 |
| CaMax: 2223a | | | | | |
| CaMax: 2224a | ENSG00000116690 | ENST00000251819 | PROTEOGLYCAN 4; MEGAKARYOCYTE STIMULATING FACTOR; PROTEOGLYCAN 4, (MEGAKARYOCYTE STIMULATING FACTOR, ARTICULAR SUPERFICIAL ZONE PROTEIN); JACOBS CAMPTODACTYLY-ARTHROPATHY-PERICARDITIS SYNDROME; CAMPTODACTYLY, ARTHROPATHY, COXA VARA, PERICARDITIS SYNDROME. [Source: RefSeq; Acc: NM_005807] | 1 | q31.1 |

TABLE 2A-continued

| CaMax Gene ID | Ensemble Gene ID | Ensemble Transcript ID | Description | Chrom No. | Chrom Loc. |
|---|---|---|---|---|---|
| CaMax: 2225b | ENSG00000151544 | ENST00000281234 | | 10 | q25.3 |
| CaMax: 2234a | ENSMUSG00000038760 | ENSMUST00000038856 | THYROTROPIN-RELEASING HORMONE RECEPTOR (TRH-R) (THYROLIBERIN RECEPTOR). [Source: SWISSPROT; Acc: P21761] | 15 | D1 |
| CaMax: 2235a | | | | | |
| CaMax: 2235a | | | | | |
| CaMax: 2238a | ENSG00000172572 | ENST00000325802 | CGMP-INHIBITED 3',5'-CYCLIC PHOSPHODIESTERASE A (EC 3.1.4.17) (CYCLIC GMP INHIBITED PHOSPHODIESTERASE A) (CGI-PDE A). [Source: SWISSPROT; Acc: Q14432] | 12 | p12.2 |
| CaMax: 2241a | ENSG00000172572 | ENST00000325802 | CGMP-INHIBITED 3',5'-CYCLIC PHOSPHODIESTERASE A (EC 3.1.4.17) (CYCLIC GMP INHIBITED PHOSPHODIESTERASE A) (CGI-PDE A). [Source: SWISSPROT; Acc: Q14432] | 12 | p12.2 |
| CaMax: 2238a | ENSG00000172572 | ENST00000325802 | CGMP-INHIBITED 3',5'-CYCLIC PHOSPHODIESTERASE A (EC 3.1.4.17) (CYCLIC GMP INHIBITED PHOSPHODIESTERASE A) (CGI-PDE A). [Source: SWISSPROT; Acc: Q14432] | 12 | p12.2 |
| CaMax: 224a | | | | | |
| CaMax: 2251d | | | | | |
| CaMax: 2252b | ENSG00000109775 | ENST00000264689 | | 4 | q35.1 |
| CaMax: 2258a | | | | | |
| CaMax: 2258a | | | | | |
| CaMax: 2258a | | | | | |
| CaMax: 225a | | | | | |
| CaMax: 2264b | | | | | |
| CaMax: 2264b | | | | | |
| CaMax: 2266b | | | | | |
| CaMax: 2267a | ENSG00000137801 | ENST00000260356 | THROMBOSPONDIN 1 PRECURSOR. [Source: SWISSPROT; Acc: P07996] | 15 | q14 |
| CaMax: 231a | | | | | |
| CaMax: 2331c | | | | | |
| CaMax: 2341b | ENSG00000119397 | ENST00000238341 | | 9 | q33.2 |
| CaMax: 2351c | | | | | |
| CaMax: 2351c | | | | | |
| CaMax: 2241a | ENSG00000172572 | ENST00000325802 | CGMP-INHIBITED 3',5'-CYCLIC PHOSPHODIESTERASE A (EC 3.1.4.17) (CYCLIC GMP INHIBITED PHOSPHODIESTERASE A) (CGI-PDE A). [Source: SWISSPROT; Acc: Q14432] | 12 | p12.2 |

TABLE 2A-continued

| CaMax Gene ID | Ensemble Gene ID | Ensemble Transcript ID | Description | Chrom No. | Chrom Loc. |
|---|---|---|---|---|---|
| CaMax: 235a | | | | | |
| CaMax: 2374a | ENSG00000137801 | ENST00000260356 | THROMBOSPONDIN 1 PRECURSOR. [Source: SWISSPROT; Acc: P07996] | 15 | q14 |
| CaMax: 238a | | | | | |
| CaMax: 239a | ENSG00000119363 | ENST00000238302 | SPECTRIN ALPHA CHAIN, BRAIN (SPECTRIN, NON-ERYTHROID ALPHA CHAIN) (ALPHA-II SPECTRIN) (FODRIN ALPHA CHAIN). [Source: SWISSPROT; Acc: Q13813] | 9 | q34.11 |
| CaMax: 23a | ENSG00000162419 | ENST00000294409 | GLUCOCORTICOID MODULATORY ELEMENT BINDING PROTEIN 1 (GMEB-1) (PARVOVIRUS INITIATION FACTOR P96) (PIF P96) (DNA BINDING PROTEIN P96PIF). [Source: SWISSPROT; Acc: Q9Y692] | 1 | p35.3 |
| CaMax: 240a | ENSG00000154144 | ENST00000284290 | | 11 | q24.2 |
| CaMax: 243a | | | | | |
| CaMax: 245a | ENSG00000166800 | ENST00000280706 | | 11 | p15.1 |
| CaMax: 248a | ENSG00000162437 | ENST00000294428 | | 1 | p31.3 |
| CaMax: 24a | | | | | |
| CaMax: 258a | | | | | |
| CaMax: 261c | | | | | |
| CaMax: 261c | | | | | |
| CaMax: 267d | ENSG00000041982 | ENST00000265131 | TENASCIN PRECURSOR (TN) (HEXABRACHION) (CYTOTACTIN) (NEURONECTIN) (GMEM) (JI) (MIOTENDINOUS ANTIGEN) (GLIOMA-ASSOCIATED-EXTRACELLULAR MATRIX ANTIGEN) (GP 150-225) (TENASCIN-C) (TN-C). [Source: SWISSPROT; Acc: P24821] | 9 | q33.1 |
| CaMax: 272d | ENSG00000141642 | ENST00000269466 | ELAC HOMOLOG 1. [Source: RefSeq; Acc: NM_018696] | 18 | q21.1 |
| CaMax: 27a | | | | | |
| CaMax: 28s | | | | | |
| CaMax: 307b | ENSG00000141378 | ENST00000311824 | PROTEIN CGI-147. [Source: SWISSPROT; Acc: Q9Y3E5] | 17 | q23.2 |
| CaMax: 308c | ENSG00000116745 | ENST00000262340 | RETINAL PIGMENT EPITHELIUM-SPECIFIC PROTEIN 65 KDA; RETINAL PIGMENT EPITHELIUM-SPECIFIC PROTEIN (65 KD); RETINITIS PIGMENTOSA 20 (AUTOSOMAL RECESSIVE). [Source: RefSeq; Acc: NM_000329] | 1 | p31.2 |
| CaMax: 310h | | | | | |
| CaMax: 311c | | | | | |
| CaMax: 313a | | | | | |
| CaMax: 314a | | | | | |
| CaMax: 319b | | | | | |

TABLE 2A-continued

| CaMax Gene ID | Ensemble Gene ID | Ensemble Transcript ID | Description | Chrom No. | Chrom Loc. |
|---|---|---|---|---|---|
| CaMax: 320a | ENSG00000090989 | ENST00000317642 ENST00000333951 | EXOCYST COMPLEX COMPONENT SEC3 (BM-012). [Source: SWISSPROT; Acc: Q9NV70] | 4 | q12 |
| CaMax: 320a | | | | | |
| CaMax: 322a | | | | | |
| CaMax: 324a | ENSG00000135913 | ENST00000258399 | | 2 | q35 |
| CaMax: 326e | ENSMUSG00000025724 | ENSMUST00000026818 | MICROSOMAL SIGNAL PEPTIDASE 18 KDA SUBUNIT (EC 3.4.—.—) (SPASE 18 KDA SUBUNIT) (SPC18) (ENDOPEPTIDASE SP18). [Source: SWISSPROT; Acc: Q9R0P6] | 7 | D2 |
| CaMax: 327f | | | | | |
| CaMax: 327f | | | | | |
| CaMax: 328b | ENSG00000129116 | ENST00000261509 ENST00000335213 ENST00000333488 | PALLADIN; CGI-151 PROTEIN. [Source: RefSeq; Acc: NM_016081] | 4 | q32.3 |
| CaMax: 336a | ENSG00000173320 | ENST00000308497 | | 4 | q35.1 |
| CaMax: 33a | | | | | |
| CaMax: 33a | | | | | |
| CaMax: 340a | | | | | |
| CaMax: 340a | | | | | |
| CaMax: 343b | | | | | |
| CaMax: 343b | | | | | |
| CaMax: 34a | | | | | |
| CaMax: 34a | | | | | |
| CaMax: 106a | ENSG00000167996 | ENST00000301775 | FERRITIN HEAVY CHAIN (FERRITIN H SUBUNIT). [Source: SWISSPROT; Acc: P02794] | 11 | q12.3 |
| CaMax: 106a | ENSG00000167996 | ENST00000301775 | FERRITIN HEAVY CHAIN (FERRITIN H SUBUNIT). [Source: SWISSPROT; Acc: P02794] | 11 | q12.3 |
| CaMax: 360a | | | | | |
| CaMax: 360a | | | | | |
| CaMax: 364a | ENSG00000182944 | ENST00000331029 ENST00000329871 | RNA-BINDING PROTEIN EWS (EWS ONCOGENE) (EWING SARCOMA BREAKPOINT REGION 1 PROTEIN). [Source: SWISSPROT; Acc: Q01844] | 22 | q12.2 |
| CaMax: 370a | | | | | |
| CaMax: 374a | ENSG00000136938 | ENST00000277182 | ACIDIC LEUCINE-RICH NUCLEAR PHOSPHOPROTEIN 32 FAMILY MEMBER B (PHAPI2 PROTEIN) (SILVER-STAINABLE PROTEIN SSP29) (ACIDIC PROTEIN RICH IN LEUCINES). [Source: SWISSPROT; Acc: Q92688] | 9 | q22.33 |
| CaMax: 375d | | | | | |
| CaMax: 379a | | | | | |
| CaMax: 38a | ENSG00000145216 | ENST00000306932 ENST00000273816 | FIP1-LIKE 1; REARRANGED IN HYPEREOSINOPHILIA. [Source: RefSeq; Acc: NM_030917] | 4 | q12 |

TABLE 2A-continued

| CaMax Gene ID | Ensemble Gene ID | Ensemble Transcript ID | Description | Chrom No. | Chrom Loc. |
|---|---|---|---|---|---|
| CaMax: 391a | | | | | |
| CaMax: 392a | | | | | |
| CaMax: 392a | | | | | |
| CaMax: 395a | | | | | |
| CaMax: 395a | | | | | |
| CaMax: 397b | | | | | |
| CaMax: 3c | ENSRNOG00000006864 | | | 8 | q24 |
| CaMax: 406a-r | | | | | |
| CaMax: 406a-r | | | | | |
| CaMax: 408a | | | | | |
| CaMax: 409a | | | | | |
| CaMax: 415b | ENSG00000134001 | ENST00000256383 | EUKARYOTIC TRANSLATION INITIATION FACTOR 2 SUBUNIT 1 (EUKARYOTIC TRANSLATION INITIATION FACTOR 2 ALPHA SUBUNIT) (EIF-2-ALPHA) (EIF-2ALPHA) (EIF-2A). [Source: SWISSPROT; Acc: P05198] | 14 | q23.3 |
| CaMax: 421a | | | | | |
| CaMax: 43a | ENSG00000174132 | ENST00000312637 | | 5 | q21.1 |
| CaMax: 446f | | | | | |
| CaMax: 44c | | | | | |
| CaMax: 44c | | | | | |
| CaMax: 45.1b | | | | | |
| CaMax: 45.1b | | | | | |
| CaMax: 450a | | | | | |
| CaMax: 450a | | | | | |
| CaMax: 452a | | | | | |
| CaMax: 455c | | | | | |
| CaMax: 455c | | | | | |
| CaMax: 457c | | | | | |
| CaMax: 459a | ENSG00000102908 | ENST00000317142 | NUCLEAR FACTOR OF ACTIVATED T CELLS 5 (T CELL TRANSCRIPTION FACTOR NFAT5) (NF-AT5) (TONICITY-RESPONSIVE ENHANCER-BINDING PROTEIN) (TONE-BINDING PROTEIN) (TONEBP). [Source: SWISSPROT; Acc: O94916] | 16 | q22.1 |
| CaMax: 461a | | | | | |
| CaMax: 461a | | | | | |
| CaMax: 464b | ENSG00000035687 | ENST00000263828 | ADENYLOSUCCINATE SYNTHETASE (EC 6.3.4.4) (IMP--ASPARTATE LIGASE) (ADSS) (AMPSASE). [Source: SWISSPROT; Acc: P30520] | 1 | q44 |

TABLE 2A-continued

| CaMax Gene ID | Ensemble Gene ID | Ensemble Transcript ID | Description | Chrom No. | Chrom Loc. |
|---|---|---|---|---|---|
| CaMax: 465b | ENSG00000064309 | ENST00000263577 | SURFACE GLYCOPROTEIN, IG SUPERFAMILY MEMBER. [Source: RefSeq; Acc: NM_016952] | 11 | q24.2 |
| CaMax: 46a | | | | | |
| CaMax: 472a | | | | | |
| CaMax: 472a | | | | | |
| CaMax: 478a | ENSG00000165169 | ENST00000297871 | T-COMPLEX ASSOCIATED-TESTIS-EXPRESSED 1-LIKE (PROTEIN 91/23). [Source: SWISSPROT; Acc: P51808] | 24 | p11.4 |
| CaMax: 479c | ENSG00000165169 | ENST00000297871 | T-COMPLEX ASSOCIATED-TESTIS-EXPRESSED 1-LIKE (PROTEIN 91/23). [Source: SWISSPROT; Acc: P51808] | 24 | p11.4 |
| CaMax: 482a | | | | | |
| CaMax: 487a | ENSG00000116584 | ENST00000313695 ENST00000313667 | RHO GUANINE NUCLEOTIDE EXCHANGE FACTOR 2 (GEF-H1 PROTEIN) (PROLIFERATING CELL NUCLEOLAR ANTIGEN P40). [Source: SWISSPROT; Acc: Q92974] | 1 | q22 |
| CaMax: 488a | ENSG00000159399 | ENST00000290573 | HEXOKINASE, TYPE II (EC 2.7.1.1) (HK II) (MUSCLE FORM HEXOKINASE). [Source: SWISSPROT; Acc: P52789] | 2 | p12 |
| CaMax: 48b | | | | | |
| CaMax: 48b | | | | | |
| CaMax: 490c | | | | | |
| CaMax: 490c | | | | | |
| CaMax: 494a | | | | | |
| CaMax: 494a | | | | | |
| CaMax: 498a | | | | | |
| CaMax: 50.1c | | | | | |
| CaMax: 50.1c | | | | | |
| CaMax: 501b | | | | | |
| CaMax: 504a | | | | | |
| CaMax: 505b | | | | | |
| CaMax: 507a | | | | | |
| CaMax: 516c | | | | | |
| CaMax: 517c | | | | | |
| CaMax: 51a | | | | | |
| CaMax: 51a | | | | | |
| CaMax: 520a | ENSG00000179454 | ENST00000324772 | BTB (POZ) DOMAIN CONTAINING 5. [Source: RefSeq; Acc: NM_017658] | 14 | q21.2 |
| CaMax: 521b | ENSG00000081189 | ENST00000325423 | MYOCYTE-SPECIFIC ENHANCER FACTOR 2C. [Source: SWISSPROT; Acc: Q06413] | 5 | q14.3 |
| CaMax: 523a | | | | | |
| CaMax: 52a | | | | | |

TABLE 2A-continued

| CaMax Gene ID | Ensemble Gene ID | Ensemble Transcript ID | Description | Chrom No. | Chrom Loc. |
|---|---|---|---|---|---|
| CaMax: 530b | ENSG00000100567 | ENST00000216455 | PROTEASOME SUBUNIT ALPHA TYPE 3 (EC 3.4.25.1) (PROTEASOME COMPONENT C8) (MACROPAIN SUBUNIT C8) (MULTICATALYTIC ENDOPEPTIDASE COMPLEX SUBUNIT C8). [Source: SWISSPROT; Acc: P25788] | 14 | q23.1 |
| CaMax: 538a | | | | | |
| CaMax: 539a | ENSG00000133059 | ENST00000255422 ENST00000335353 | HDCMD38P. [Source: SPTREMBL; Acc: Q9P1S5] | 1 | q32.1 |
| CaMax: 540a | | | | | |
| CaMax: 543a | | | | | |
| CaMax: 545a | ENSG00000144785 | ENST00000273308 | TRANSMEMBRANE PROTEIN 4. [Source: RefSeq; Acc: NM_014255] | 12 | q13.3 |
| CaMax: 547c | ENSG00000174560 | ENST00000310012 | | 6 | q12 |
| CaMax: 548c | ENSG00000174560 | ENST00000310012 | | 6 | q12 |
| CaMax: 550a | ENSG00000133226 | ENST00000334537 ENST00000323848 | SER/ARG-RELATED NUCLEAR MATRIX PROTEIN (PLENTY OF PROLINES 101-L; SER/ARG-RELATED NUCLEAR MATRIX PROTEIN (PLENTY OF PROLINES 101-LIKE). [Source: RefSeq; Acc: NM_005839] | 1 | p36.11 |
| CaMax: 552a | | | | | |
| CaMax: 553b | ENSG00000180185 | ENST00000326061 | | 16 | p13.3 |
| CaMax: 555b | ENSG00000005812 | ENST00000281993 | F-BOX AND LEUCINE-RICH REPEAT PROTEIN 3A; F-BOX PROTEIN FBL3A. [Source: RefSeq; Acc: NM_012158] | 13 | q22.3 |
| CaMax: 556b | | | | | |
| CaMax: 557b | | | | | |
| CaMax: 558a | | | | | |
| CaMax: 558a | | | | | |
| CaMax: 560b | | | | | |
| CaMax: 561b | | | | | |
| CaMax: 568a | | | | | |
| CaMax: 568a | | | | | |
| CaMax: 56a | | | | | |
| CaMax: 56a | | | | | |
| CaMax: 571a | ENSG00000143924 | ENST00000318522 | ECHINODERM MICROTUBULE-ASSOCIATED PROTEIN-LIKE 4 (EMAP-4) (RESTRICTEDLY OVEREXPRESSED PROLIFERATION-ASSOCIATED PROTEIN) (ROPP 120). [Source: SWISSPROT; Acc: Q9HC35] | 2 | p21 |
| CaMax: 574a | | | | | |
| CaMax: 579a | ENSG00000124193 | ENST00000244020 | SPLICING FACTOR, ARGININE/SERINE-RICH 6 (PRE-MRNA SPLICING FACTOR SRP55). [Source: SWISSPROT; Acc: Q13247] | 20 | q13.11 |

TABLE 2A-continued

| CaMax Gene ID | Ensemble Gene ID | Ensemble Transcript ID | Description | Chrom No. | Chrom Loc. |
|---|---|---|---|---|---|
| CaMax: 57a | ENSG00000091409 | ENST00000264107 ENST00000264106 | INTEGRIN ALPHA-6 PRECURSOR (VLA-6) (CD49F). [Source: SWISSPROT; Acc: P23229] | 2 | q31.1 |
| CaMax: 581a | ENSG00000115112 | ENST00000263707 | LBP-9. [Source: RefSeq; Acc: NM_014553] | 2 | q14.2 |
| CaMax: 583e | ENSMUSG00000026193 | ENSMUST00000055226 ENSMUST00000059577 ENSMUST00000027385 | | 1 | C3 |
| CaMax: 58a | | | | | |
| CaMax: 597c | ENSG00000171634 | ENST00000306378 ENST00000335221 ENST00000321866 ENST00000321892 | FETAL ALZHEIMER ANTIGEN (FETAL ALZ-50-REACTIVE CLONE 1). [Source: SWISSPROT; Acc: Q12830] | 17 | q24.2 |
| CaMax: 59a | | | | | |
| CaMax: 59a | | | | | |
| CaMax: 609a | | | | | |
| CaMax: 611a | | | | | |
| CaMax: 622a | | | | | |
| CaMax: 622a | | | | | |
| CaMax: 623a | ENSG00000140575 | ENST00000268182 | RAS GTPASE-ACTIVATING-LIKE PROTEIN IQGAP1 (P195). [Source: SWISSPROT; Acc: P46940] | 15 | q26.1 |
| CaMax: 624b | | | | | |
| CaMax: 626a | | | | | |
| CaMax: 626a | | | | | |
| CaMax: 628a | ENSG00000183762 | ENST00000327813 | KREMEN PROTEIN 1 PRECURSOR (KRINGLE-CONTAINING PROTEIN MARKING THE EYE AND THE NOSE) (DICKKOPF RECEPTOR). [Source: SWISSPROT; Acc: Q96MU8] | 22 | q12.1 |
| CaMax: 635a | ENSG00000133226 | ENST00000334537 ENST00000323848 | SER/ARG-RELATED NUCLEAR MATRIX PROTEIN (PLENTY OF PROLINES 101-L; SER/ARG-RELATED NUCLEAR MATRIX PROTEIN (PLENTY OF PROLINES 101-LIKE). [Source: RefSeq; Acc: NM_005839] | 1 | p36.11 |
| CaMax: 638b | ENSG00000165169 | ENST00000297871 | T-COMPLEX ASSOCIATED-TESTIS-EXPRESSED 1-LIKE (PROTEIN 91/23). [Source: SWISSPROT; Acc: P51808] | 24 | p11.4 |
| CaMax: 639a | | | | | |
| CaMax: 63a | | | | | |
| CaMax: 63a | | | | | |
| CaMax: 64.2a | ENSG00000144560 | ENST00000273038 | | 3 | p25.3 |
| CaMax: 685a | ENSG00000125149 | ENST00000219139 | UPF0183 PROTEIN. [Source: SWISSPROT; Acc: Q9BSU1] | 16 | q22.1 |
| CaMax: 690a | | | | | |
| CaMax: 690a | | | | | |
| CaMax: 692a | ENSG00000171567 | ENST00000304782 | TIGGER TRANSPOSABLE ELEMENT DERIVED 1; JERKY (MOUSE) HOMOLOG-LIKE. [Source: RefSeq; Acc: NM_145702] | 2 | q37.1 |

TABLE 2A-continued

| CaMax Gene ID | Ensemble Gene ID | Ensemble Transcript ID | Description | Chrom No. | Chrom Loc. |
|---|---|---|---|---|---|
| CaMax: 697a | ENSRNOG00000007325 | | | 8 | q23 |
| CaMax: 6b | | | | | |
| CaMax: 701a | ENSMUSG00000032077 | ENSMUST00000036099 | | 9 | B |
| CaMax: 704b | ENSG00000119509 | ENST00000262457 ENST00000262456 | INVERSIN. [Source: RefSeq; Acc: NM_014425] | 9 | q22.33 |
| CaMax: 704b | ENSG00000119509 | ENST00000262457 ENST00000262456 | INVERSIN. [Source: RefSeq; Acc: NM_014425] | 9 | q22.33 |
| CaMax: 70d | | | | | |
| CaMax: 710a | ENSG00000123500 | ENST00000243222 | COLLAGEN ALPHA 1(X) CHAIN PRECURSOR. [Source: SWISSPROT; Acc: Q03692] | 6 | q22.1 |
| CaMax: 711a | | | | | |
| CaMax: 711a | | | | | |
| CaMax: 713a | | | | | |
| CaMax: 713a | | | | | |
| CaMax: 714a | | | | | |
| CaMax: 718a | | | | | |
| CaMax: 720a | | | | | |
| CaMax: 725a | ENSG00000133454 | ENST00000335473 ENST00000335460 ENST00000335471 ENST00000335359 | | 22 | q12.1 |
| CaMax: 726b | ENSG00000122912 | ENST00000265870 | GRAVE'S DISEASE CARRIER PROTEIN (GDC) (GRAVE'S DISEASE AUTOANTIGEN) (GDA) (MITOCHONDRIAL SOLUTE CARRIER PROTEIN HOMOLOG). [Source: SWISSPROT; Acc: P16260] | 10 | q21.3 |
| CaMax: 72a | | | | | |
| CaMax: 72a | | | | | |
| CaMax: 731a | | | | | |
| CaMax: 731a | | | | | |
| CaMax: 736a | ENSG00000130066 | ENST00000252349 | DIAMINE ACETYLTRANSFERASE (EC 2.3.1.57) (SPERMIDINE/SPERMINE N(1)-ACETYLTRANSFERASE) (SSAT) (PUTRESCINE ACETYLTRANSFERASE). [Source: SWISSPROT; Acc: P21673] | 24 | p22.11 |
| CaMax: 739a | ENSG00000166938 | ENST00000319194 ENST00000319212 | | 15 | q22.31 |
| CaMax: 73b | ENSG00000112473 | ENST00000230235 ENST00000325843 | HISTIDINE-RICH MEMBRANE PROTEIN KE4. [Source: SWISSPROT; Acc: Q92504] | 6 | p21.32 |
| CaMax: 745a | | | | | |
| CaMax: 747a | ENSG00000164190 | ENST00000296607 ENST00000282516 | IDN3 PROTEIN ISOFORM A. [Source: RefSeq; Acc: NM_133433] | 5 | p13.2 |
| CaMax: 749a | | | | | |
| CaMax: 74c | | | | | |
| CaMax: 753b | ENSMUSG00000039203 | ENSMUST00000036300 | | 4 | C1 |
| CaMax: 759b | | | | | |

TABLE 2A-continued

| CaMax Gene ID | Ensemble Gene ID | Ensemble Transcript ID | Description | Chrom No. | Chrom Loc. |
|---|---|---|---|---|---|
| CaMax: 759b | | | | | |
| CaMax: 764b | | | | | |
| CaMax: 764b | | | | | |
| CaMax: 765a | ENSG00000102763 | ENST00000251030 | | 13 | q14.11 |
| CaMax: 768a | | ENST00000281496 | | | |
| CaMax: 76b | | | | | |
| CaMax: 785b | ENSG00000171867 | ENST00000305832 | MAJOR PRION PROTEIN PRECURSOR (PRP) (PRP27-30) (PRP33-35C) (ASCR) (CD230 ANTIGEN). [Source: SWISSPROT; Acc: P04156] | 20 | p13 |
| CaMax: 788a | | | | | |
| CaMax: 789a | ENSG00000102471 | ENST00000218652 | | 13 | q31.1 |
| CaMax: 794a | ENSG00000123096 | ENST00000242729 | SARCOSPAN (K-RAS ONCOGENE-ASSOCIATED PROTEIN) (KIRSTEN-RAS-ASSOCIATED PROTEIN). [Source: SWISSPROT; Acc: Q14714] | 12 | p12.1 |
| CaMax: 795a | ENSG00000106554 | ENST00000262570 | | 7 | q32.3 |
| CaMax: 810a | ENSG00000131388 | ENST00000253706 | | 3 | p25.1 |
| CaMax: 813a | | | | | |
| CaMax: 815a | | | | | |
| CaMax: 81a | | | | | |
| CaMax: 820a | | | | | |
| CaMax: 820a | | | | | |
| CaMax: 827b | | | | | |
| CaMax: 827b | | | | | |
| CaMax: 828a | | | | | |
| CaMax: 82b | | | | | |
| CaMax: 831a | | | | | |
| CaMax: 831a | | | | | |
| CaMax: 832a | ENSMUSG00000026193 | ENSMUST00000055226 ENSMUST00000059577 ENSMUST00000027385 | | 1 | C3 |
| CaMax: 833a | ENSG00000090581 | ENST00000204679 | | 16 | p13.3 |
| CaMax: 835c | | | | | |
| CaMax: 839a | ENSG00000068885 | ENST00000326448 | | 3 | q25.33 |
| CaMax: 841b | | | | | |
| CaMax: 841b | | | | | |
| CaMax: 847a | | | | | |
| CaMax: 85.1c | ENSG00000136003 | ENST00000311893 ENST00000228459 | NITROGEN FIXATION CLUSTER-LIKE. [Source: RefSeq; Acc: NM_014301] | 12 | q23.3 |
| CaMax: 85.2b | ENSG00000149218 | ENST00000278505 | | 11 | q21 |
| CaMax: 850a | | | | | |
| CaMax: 851a | | | | | |

TABLE 2A-continued

| CaMax Gene ID | Ensemble Gene ID | Ensemble Transcript ID | Description | Chrom No. | Chrom Loc. |
|---|---|---|---|---|---|
| CaMax: 856c | ENSG00000060982 | ENST00000261192 ENST00000334327 | BRANCHED-CHAIN AMINO ACID AMINOTRANSFERASE, CYTOSOLIC (EC 2.6.1.42) (BCAT(C)) (ECA39 PROTEIN). [Source: SWISSPROT; Acc: P54687] | 12 | p12.1 |
| CaMax: 863c | ENSMUSG00000022676 | ENSMUST00000023356 | ZINC FINGER PROTEIN SLUG (NEURAL CREST TRANSCRIPTION FACTOR SLUG) (SNAIL HOMOLOG 2). [Source: SWISSPROT; Acc: P97469] | 16 | B1 |
| CaMax: 890a | ENSG00000175582 | ENST00000310653 ENST00000334372 | RAS-RELATED PROTEIN RAB-6A (RAB-6). [Source: SWISSPROT; Acc: P20340] | 11 | q13.4 |
| CaMax: 8a | | | | | |
| CaMax: 905a | | | | | |
| CaMax: 906a | | | | | |
| CaMax: 907a | | | | | |
| CaMax: 909a | ENSG00000145730 | ENST00000304400 ENST00000304406 ENST00000282992 ENST00000325306 ENST00000274392 | PEPTIDYL-GLYCINE ALPHA-AMIDATING MONOOXYGENASE PRECURSOR (EC 1.14.17.3) (PAM). [Source: SWISSPROT; Acc: P19021] | 5 | q21.1 |
| CaMax: 90c | ENSMUSG00000023944 | ENSMUST00000024739 | HEAT SHOCK PROTEIN HSP 90-BETA (HSP 84) (TUMOR SPECIFIC TRANSPLANTATION 84 KDA ANTIGEN) (TSTA). [Source: SWISSPROT; Acc: P11499] | 17 | C |
| CaMax: 911a | | | | | |
| CaMax: 911a | | | | | |
| CaMax: 912b | | | | | |
| CaMax: 914a | | | | | |
| CaMax: 914a | | | | | |
| CaMax: 915a | | | | | |
| CaMax: 915a | | | | | |
| CaMax: 919b | ENSG00000104177 | ENST00000267836 ENST00000324324 | MYELIN GENE EXPRESSION FACTOR 2. [Source: RefSeq; Acc: NM_016132] | 15 | q21.1 |
| CaMax: 91f | | | | | |
| CaMax: 91f | | | | | |
| CaMax: 919b | ENSG00000104177 | ENST00000267836 ENST00000324324 | MYELIN GENE EXPRESSION FACTOR 2. [Source: RefSeq; Acc: NM_016132] | 15 | q21.1 |
| CaMax: 92c | ENSG00000084676 | ENST00000288599 ENST00000326011 | NUCLEAR RECEPTOR COACTIVATOR 1 ISOFORM 1. [Source: RefSeq; Acc: NM_003743] | 2 | p23.3 |
| CaMax: 935b | ENSG00000125953 | ENST00000246165 | CHURCHILL PROTEIN (MY015 PROTEIN). [Source: SWISSPROT; Acc: Q8WUH1] | 14 | q23.3 |
| CaMax: 936b | | | | | |
| CaMax: 936b | | | | | |
| CaMax: 945a | ENSRNOG00000011175 | | | 4 | q24 |
| CaMax: 947a | | | | | |
| CaMax: 947a | | | | | |

TABLE 2A-continued

| CaMax Gene ID | Ensemble Gene ID | Ensemble Transcript ID | Description | Chrom No. | Chrom Loc. |
|---|---|---|---|---|---|
| CaMax: 949c | ENSG00000144592 | ENST00000316654 ENST00000273079 | | 3 | p25.1 |
| CaMax: 953a | ENSMUSG00000021290 | ENSMUST00000021719 | 6.8 KDA MITOCHONDRIAL PROTEOLIPID. [Source: SWISSPROT; Acc: P56379] | 12 | F2 |
| CaMax: 963c | ENSG00000134644 | ENST00000257075 | PUMILIO HOMOLOG 1. [Source: RefSeq; Acc: NM_014676] | 1 | p35.2 |
| CaMax: 96e | | | | | |
| CaMax: 981a | | | | | |
| CaMax: 984a | | | | | |
| CaMax: 984a | | | | | |
| CaMax: 986a | ENSG00000118971 | ENST00000261254 | G1/S-SPECIFIC CYCLIN D2. [Source: SWISSPROT; Acc: P30279] | 12 | p13.32 |
| CaMax: 990a | ENSG00000125398 | ENST00000245479 | TRANSCRIPTION FACTOR SOX-9. [Source: SWISSPROT; Acc: P48436] | 17 | q24.3 |
| CaMax: 992a | | | | | |
| CaMax: 994b | ENSG00000005700 | ENST00000306270 | INHIBITOR OF BRUTON'S TYRSOINE KINASE; BTK-BINDING PROTEIN. [Source: RefSeq; Acc: NM_015525] | 6 | q14.1 |
| CaMax: 996a | ENSG00000008988 | ENST00000009589 | 40S RIBOSOMAL PROTEIN S20. [Source: SWISSPROT; Acc: P17075] | 8 | q12.1 |

TABLE 2B

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 1002b | ENST00000244769 | | | | | | | |
| CaMax: 1002b | ENST00000244769 | | | | | | | |
| CaMax: 1005a | | | NM_178043 NM_032239 NM_018078 | PF05383 | IPR001199 | | | |
| CaMax: 1006b | TISD_HUMAN | | NM_006887 | PF04553 PF00642 | IPR000571 IPR007635 | | | ZFP36L2 |
| CaMax: 1007a | TISD_HUMAN | | NM_006887 | PF04553 PF00642 | IPR000571 IPR007635 | | | ZFP36L2 |
| CaMax: 1008a | ENST00000245479 | | | | | | | |
| CaMax: 1008a | ENST00000245479 | | | | | | | |
| CaMax: 1009c | GDC_HUMAN | 139080 | NM_152707 | PF00153 | IPR001993 IPR002167 IPR002067 | | | SLC25A16 |
| CaMax: 1011a | trembl\|AB012223_1 | | | | | | | |
| CaMax: 1011a | Transcript: ENSRNOT00000033408 | | | | | | | |
| CaMax: 1013a | ENST000000326567 | | | | | | | |
| CaMax: 1015d | | | NM_018359 | | | | | |
| CaMax: 1016b | Transcript: ENST00000330345 | | | | | | | |
| CaMax: 1019a | Z333_HUMAN | | NM_032433 | PF01352 PF00096 | IPR007087 IPR007086 IPR001909 | | | |
| CaMax: 1020a | CGRR_HUMAN | 114190 | NM_005795 | PF02793 PF00002 | IPR000832 IPR003287 IPR003289 IPR001688 IPR001879 | Sigp | Tmhmm | CALCRL |
| CaMax: 1026b | trembl\|AB012223_1 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 1026b | Transcript: ENSRNOT00000035961 | | | | | | | |
| CaMax: 1028c | trembl\|HSRBP1_1 | | | | | | | |
| CaMax: 1028c | ENST00000260780 | | | | | | | |
| CaMax: 1029a | | | NM_145702 | PF04218 PF03184 | IPR004875 IPR006695 | | | TIGD1 |
| CaMax: 103a | ENST00000287239 | | | | | | | |
| CaMax: 1044c | PPO3_HUMAN | 607726 | NM_005485 | PF05406 PF02877 PF00644 | IPR001290 IPR004102 | | | ADPRTL3 |
| CaMax: 104a | ROH1_HUMAN | 601035 | NM_005520 | PF00076 | IPR000504 | | | HNRPH1 |
| CaMax: 1050a | ENST00000322598 | | | | | | | |
| CaMax: 1054a | ENST00000261710 | | | | | | | |
| CaMax: 1057b | trembl\|AB012223_1 | | | | | | | |
| CaMax: 1060a | pironly\|S72489 | | | | | | | |
| CaMax: 1061a | | | | PF02008 | IPR002857 | | | |
| CaMax: 1063b | ENST00000277359 | | | | | | | |
| CaMax: 106a | FRIH_HUMAN | 134770 | NM_002032 | PF00210 | IPR001519 | | | FTH1 |
| CaMax: 1070b | Transcript: ENST00000322595 | | | | | | | |
| CaMax: 1072a | trembl\|HS09953_1 | | | | | | | |
| CaMax: 1072a | ENST00000295955 | | | | | | | |
| CaMax: 1089d | gpnew\|37790758 | | | | | | | |
| CaMax: 108a | ENST00000297846 | | | | | | | |
| CaMax: 1090d | swiss\|ATP6_CANFA | | | | | | | |
| CaMax: 1094b | gpnew\|37790758 | | | | | | | |
| CaMax: 1094b | ENSMUST00000006525 | | | | | | | |
| CaMax: 1095a | | | NM_019974 NM_133712 | PF00089 | IPR001254 IPR001314 | Sigp | | Prss20-pending 2300002A13Rik |
| CaMax: 1096a | | | NM_019974 NM_133712 | PF00089 | IPR001254 IPR001314 | Sigp | | Prss20-pending 2300002A13Rik |
| CaMax: 1098a | | | NM_014796 | | | | | |
| CaMax: 109a | | | NM_032202 | | IPR001969 | | | |
| CaMax: 1105a | RB14_HUMAN | | NM_016322 | PF00071 | IPR001687 IPR001806 | | | RAB14 |
| CaMax: 1106a | | | NM_152388 | | | | Tmhmm | ALS2CR4 |
| CaMax: 1108a | SR13_HUMAN | | NM_052851 | PF00620 PF01852 | IPR001687 IPR000198 IPR002913 | | | STARD13 |
| CaMax: 1110b | gpnew\|37790758 | | | | | | | |
| CaMax: 1110b | gpnew\|37790758 | | | | | | | |
| CaMax: 1111b | SES1_HUMAN | 606103 | NM_014454 | PF04636 | IPR006730 | | | SESN1 |
| CaMax: 1112a | | | NM_032042 | | IPR000886 IPR001472 | Sigp | | |
| CaMax: 111a | Transcript: ENST00000327492 | | | | | | | |
| CaMax: 1120a | | | NM_022130 | PF05719 | | | | GOLPH3 |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 1121a | | | | | IPR000566 | | | |
| CaMax: 1131b | gpnew\|37790758 | | | | | | | |
| CaMax: 1132a | trembl\|PM43360_1 | | | | | | | |
| CaMax: 1134a | MEFC_HUMAN | 600662 | NM_002397 | PF00319 | IPR002100 | | | MEF2C |
| CaMax: 1135a | FXP2_HUMAN | 605317 602081 | NM_148898 NM_148899 NM_148900 NM_014491 | PF00904 PF00250 | IPR007087 IPR001766 IPR000354 | | | FOXP2 |
| CaMax: 1137b | ENST00000256429 | | | | | | | |
| CaMax: 1138a | ENST00000261765 | | | | | | | |
| CaMax: 1139a | ENST00000245479 | | | | | | | |
| CaMax: 1145a | CA1E_HUMAN | 120325 | NM_001855 | PF02210 PF01391 | IPR008160 IPR003129 IPR001791 | Sigp | | COL15A1 |
| CaMax: 1145a | CA1E_HUMAN | | | | | | | |
| CaMax: 1146a | ENST00000308148 | | | | | | | |
| CaMax: 1159b | ENST00000296084 | | | | | | | |
| CaMax: 104a | ROH1_HUMAN | 601035 | NM_005520 | PF00076 | IPR000504 | | | HNRPH1 |
| CaMax: 1169b | TPM1_HUMAN | 191010 | NM_000366 | PF00261 | IPR000533 | | | TPM1 |
| CaMax: 1177c | DYHC_HUMAN | 600112 | NM_001376 | PF03028 | IPR001687 IPR000169 IPR004273 | | | DNCH1 |
| CaMax: 1184a | TIAM_HUMAN | 600687 | NM_003253 | PF00169 PF02196 PF00595 PF00621 | IPR001331 IPR001849 IPR001478 IPR000219 IPR003116 IPR001472 | | | TIAM1 |
| CaMax: 1184a | TIAM_HUMAN | | | | | | | |
| CaMax: 1190b | | | | PF02269 | IPR003195 | | | |
| CaMax: 1192b | | | | PF02269 | IPR003195 | | | |
| CaMax: 11b | ENST00000307407 | | | | | | | |
| CaMax: 120a | swiss\|UB15_HUMAN | | | | | | | |
| CaMax: 120a | ENST00000280377 | | | | | | | |
| CaMax: 1212b | ENST00000235420 | | | | | | | |
| CaMax: 1213d | VAV3_HUMAN | 605541 | NM_006113 | PF00307 PF00621 PF00169 PF00130 PF00017 PF00018 | IPR002086 IPR002219 IPR001331 IPR000980 IPR001452 IPR003096 IPR001849 IPR001715 IPR000219 | | | VAV3 |
| CaMax: 1217a | ENST00000305327 | | | | | | | |
| CaMax: 1220b | Transcript: ENST00000333521 | | | | | | | |
| CaMax: 1226d | ENST00000244769 | | | | | | | |
| CaMax: 1226d | ENST00000244769 | | | | | | | |
| CaMax: 123c | trembl\|AY027883_1 | | | | | | | |
| CaMax: 123c | ENST00000313779 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 1243a | WDR3_HUMAN | 604737 | NM_006784 | PF00400<br>PF04003 | IPR001680<br>IPR007148 | | | WDR3 |
| CaMax: 1245b | ENST00000319046 | | | | | | | |
| CaMax: 1246a | | | NM_018359 | | | | | |
| CaMax: 1248b | ENST00000263196 | | | | | | | |
| CaMax: 1253a | | | NM_018359 | | | | | |
| CaMax: 1257b | trembl|BC043468_1 | | | | | | | |
| CaMax: 1257b | Genscan:<br>AC073655.26.1.188105.67776.86719 | | | | | | | |
| CaMax: 1260c | ENST00000325918 | | | | | | | |
| CaMax: 1263b | | | | PF00036 | IPR002048<br>IPR000694 | | | |
| CaMax: 1267a | PCCA_HUMAN | 232000<br>606054 | NM_000282 | PF00289<br>PF02786<br>PF02785<br>PF00364 | IPR001882<br>IPR005479<br>IPR005481<br>IPR000089<br>IPR005482 | | | PCCA |
| CaMax: 1267a | PCCA_HUMAN | 232000<br>606054 | NM_000282 | PF00289<br>PF02786<br>PF02785<br>PF00364 | IPR001882<br>IPR005479<br>IPR005481<br>IPR000089<br>IPR005482 | | | PCCA |
| CaMax: 1270a | | | NM_152520 | PF00096 | IPR007087 | | | |
| CaMax: 1272a | S24A_HUMAN | 607183 | | PF04810<br>PF04811<br>PF04815<br>PF00626 | IPR007123<br>IPR006895<br>IPR006896<br>IPR006900<br>IPR000694 | | | SEC24A |
| CaMax: 1273b | trembl|AB012223_1 | | | | | | | |
| CaMax: 1276a | trembl|AB012223_1 | | | | | | | |
| CaMax: 127b | trembl|AY027883_1 | | | | | | | |
| CaMax: 127b | ENST00000313779 | | | | | | | |
| CaMax: 1282b | Genscan:<br>CAAA01209745.1.1.24557.3159.16476 | | | | | | | |
| CaMax: 1284b | ENSRNOT00000023862 | | | | | | | |
| CaMax: 1287c | | | NM_133433<br>NM_015384 | | | | | |
| CaMax: 1288a | | | NM_133433<br>NM_015384 | | | | | |
| CaMax: 128a | HS9B_MOUSE | | NM_008302 | PF02518<br>PF00183 | IPR001404<br>IPR003594 | | | Hspcb |
| CaMax: 1292c | KU86_HUMAN | 194364 | NM_021141 | PF03731<br>PF02735<br>PF03730 | IPR006164<br>IPR005160<br>IPR005161 | | | XRCC5 |
| CaMax: 1294b | SYEP_HUMAN | 138295 | NM_004446 | PF00749<br>PF03950<br>PF00458<br>PF00587<br>PF03129<br>PF00043 | IPR001589<br>IPR001412<br>IPR000738<br>IPR000924<br>IPR002316<br>IPR004046<br>IPR002314<br>IPR004154 | | | EPRS |
| CaMax: 1299c | | | NM_014991<br>NM_178583 | PF02138<br>PF00400<br>PF01363 | IPR001680<br>IPR000306<br>IPR000409 | | | WDFY3 |
| CaMax: 129b | tremblnew|<br>AX400039_1 | | | | | | | |
| CaMax: 129b | ENST00000265677 | | | | | | | |
| CaMax: 12a | ENST00000288263 | | | | | | | |
| CaMax: 1301a | | | | PF00023 | IPR002110 | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 1304a | | 607958 | NM_014178 | | | | | STXBP6 |
| CaMax: 1308c | trembl|AB012223_1 | | | | | | | |
| CaMax: 1308c | ENST00000297641 | | | | | | | |
| CaMax: 130b | ENSRNOT00000011463 | | | | | | | |
| CaMax: 1316b | ENSRNOT00000024354 | | | | | | | |
| CaMax: 1318a | LIN1_HUMAN | | | | | | | |
| CaMax: 1320 | LIN1_HUMAN | | | | | | | |
| CaMax: 1322c | OGT1_RAT | | | PF00515 | IPR001440 | | | |
| CaMax: 1323br | trembl|HS09953_1 | | | | | | | |
| CaMax: 1323br | ENST00000295955 | | | | | | | |
| CaMax: 1324a | trembl|HS09953_1 | | | | | | | |
| CaMax: 1324a | ENST00000295955 | | | | | | | |
| CaMax: 1335b | pironly|B34087 | | | | | | | |
| CaMax: 1335b | ENST00000321183 | | | | | | | |
| CaMax: 1341a | | 603054 | NM_013372 | PF03045 | IPR004133 IPR001472 | Sigp | | CKTSF1B1 |
| CaMax: 1352b | LIN1_NYCCO | | | | | | | |
| CaMax: 1354a | | | NM_145702 | PF04218 PF03184 | IPR004875 IPR006695 | | | TIGD1 |
| CaMax: 1355a | trembl|AF318340_1 | | | | | | | |
| CaMax: 1355a | ENST00000324229 | | | | | | | |
| CaMax: 1361a | FUT8_HUMAN | 602589 | NM_178157 NM_178154 NM_178155 NM_178156 NM_004480 | PF00018 | IPR001452 IPR001472 | Sigp | Tmhmm | FUT8 |
| CaMax: 1364d | trembl|AB012223_1 | | | | | | | |
| CaMax: 1364d | ENST00000304487 | | | | | | | |
| CaMax: 1366a | CTGL_HUMAN | 603399 | NM_003881 | PF00219 PF00093 PF00090 | IPR001525 IPR000867 IPR001007 IPR000884 | Sigp | | WISP2 |
| CaMax: 1368a | | | NM_026140 | PF00749 | IPR001412 IPR000924 | | | 3230401I01Rik |
| CaMax: 1371a | | 604785 | NM_003798 | PF01044 | IPR001033 IPR006077 | | | CTNNAL1 |
| CaMax: 137b | MPP8_HUMAN | | | PF00385 PF00023 | IPR000953 IPR002110 IPR001472 | | | |
| CaMax: 1381a | trembl|S77350_1 | | | | | | | |
| CaMax: 1381a | ENST00000228938 | | | | | | | |
| CaMax: 1383a | | 602942 | NM_005665 | PF00566 | IPR001687 IPR000515 IPR000195 | | | EVI5 |
| CaMax: 1384a | ACOD_HUMAN | 604031 | NM_005063 | PF00487 | IPR001522 IPR005804 | | Tmhmm | SCD |
| CaMax: 1391a | ENST00000222271 | | | | | | | |
| CaMax: 1394b | ENST00000256429 | | | | | | | |
| CaMax: 1397b | | | NM_181782 | PF01476 | IPR002482 | | | NCOA7 |
| CaMax: 1399a | ENST00000318060 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 13a | ENST00000295709 | | | | | | | |
| CaMax: 1400a | trembl\|AB012223_1 | | | | | | | |
| CaMax: 1401c | | | NM_014247 | PF00027 PF00595 PF00788 PF00617 PF00618 | IPR000595 IPR001478 IPR001895 IPR000651 IPR000159 | | | PDZGEF1 |
| CaMax: 1403a | ENST00000231061 | | | | | | | |
| CaMax: 1406a | Transcript: ENST00000298992 | | | | | | | |
| CaMax: 1409b | BAG5_HUMAN | 603885 | NM_004873 | PF02179 | IPR003103 | | | BAG5 |
| CaMax: 1411a | | 602021 | NM_002480 | PF00023 | IPR002110 | | | PPP1R12A |
| CaMax: 1415b | | | | | | | Tmhmm | 2900042B11Rik |
| CaMax: 1416a | Transcript: ENST00000336483 | | | | | | | |
| CaMax: 1419a | ENST00000325584 | | | | | | | |
| CaMax: 141c | trembl\|BC018999_1 | | | | | | | |
| CaMax: 141c | Transcript: ENST00000307901 | | | | | | | |
| CaMax: 142.1c | tremblnew\| AK001301_1 | | | | | | | |
| CaMax: 142.1c | ENST00000311713 | | | | | | | |
| CaMax: 1420c | | | NM_004748 NM_020739 | PF02987 | IPR001687 IPR004238 | | Tmhmm | |
| CaMax: 1421a | MLT1_HUMAN | 604860 | NM_006785 NM_173844 | PF00531 PF00047 PF00656 | IPR007110 IPR000488 IPR001309 | | | MALT1 |
| CaMax: 1423b | gpnew\|37790758 | | | | | | | |
| CaMax: 143.2c | SPL1_HUMAN | 606041 | NM_004684 | PF00050 | IPR002048 IPR001999 IPR002350 | Sigp | | SPARCL1 |
| CaMax: 143.2c | SPL1_HUMAN | 606041 | NM_004684 | PF00050 | IPR002048 IPR001999 IPR002350 | Sigp | | SPARCL1 |
| CaMax: 1431a | Transcript: ENST00000296858 | | | | | | | |
| CaMax: 144.2a | trembl\|AY157990_1 | | | | | | | |
| CaMax: 144.2a | ENST00000249297 | | | | | | | |
| CaMax: 1448a | TIC3_HUMAN | 607989 | NM_016950 | PF00050 PF00086 | IPR000716 IPR002350 | Sigp | Tmhmm | SPOCK3 |
| CaMax: 1449a | Z271_HUMAN ZN16_HUMAN Z268_HUMAN ZF64_HUMAN | 604754 601262 606024 604753 | NM_006958 NM_003415 | PF00096 PF01352 | IPR001687 IPR007087 IPR007086 IPR000294 IPR001909 | | | ZNF271 ZNF16 ZNF268 |
| CaMax: 1450a | C17_HUMAN | 607930 | NM_018659 | | | Sigp | | |
| CaMax: 1452a | ENST00000261976 | | | | | | | |
| CaMax: 1457b | gp\|34528169 | | | | | | | |
| CaMax: 1459c | P15_HUMAN | 600503 | NM_006713 | PF02229 | IPR003173 IPR001472 | | | |
| CaMax: 1459c | TCP4_HUMAN | | | | | | | |
| CaMax: 145b | RL10_HUMAN | 312173 | NM_006013 | PF00826 | IPR001197 | | | RPL10 |
| CaMax: 1460a | trembl\|HSU93567_2 | | | | | | | |
| CaMax: 1460a | ENST00000322543 | | | | | | | |
| CaMax: 1461a | trembl\|BC049156_1 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 1461a | ENSMUST00000030311 | | | | | | | |
| CaMax: 1466b | trembl\|AF325902_1 | | | | | | | |
| CaMax: 1466b | ENST00000222271 | | | | | | | |
| CaMax: 1469a | | | NM_023211 | | | | Tmhmm | Usmg5 |
| CaMax: 146b | Y441_HUMAN | | NM_014797 | PF00651 PF02178 PF00096 | IPR007087 IPR000345 IPR007086 IPR000210 IPR000637 | | | ZNF450 |
| CaMax: 1469a | | | NM_023211 | | | | Tmhmm | Usmg5 |
| CaMax: 1472a | ENST00000296084 | | | | | | | |
| CaMax: 1475a | CN4B_RAT | | | | | | | |
| CaMax: 1476a | ID4_HUMAN | 600581 | NM_001546 | PF00010 | IPR001092 IPR000694 | | | ID4 |
| CaMax: 1477a | BTG2_HUMAN | 601597 | NM_006763 | PF01211 | IPR002087 | | | BTG2 |
| CaMax: 147b | ENST00000317517 | | | | | | | |
| CaMax: 1481c | HXA3_HUMAN | 142954 | NM_030661 NM_153631 NM_153632 | PF00046 | IPR001356 IPR001827 IPR002965 IPR000047 IPR000694 | | | HOXA3 |
| CaMax: 1482a | | | NM_017880 | | IPR000169 | | | |
| CaMax: 1484b | UTRO_HUMAN | | | | | | | |
| CaMax: 1488b | ROA2_HUMAN | 600124 | NM_002137 NM_031243 | PF00076 | IPR000504 | | | HNRPA2B1 |
| CaMax: 148a | ENST00000271717 | | | | | | | |
| CaMax: 1497c | swiss\|SEC3_HUMAN | | | | | | | |
| CaMax: 1497c | ENST00000317675 | | | | | | | |
| CaMax: 1500b | ENST00000322519 | | | | | | | |
| CaMax: 1504d | ENST00000278824 | | | | | | | |
| CaMax: 1506d | trembl\|AY061884_1 | | | | | | | |
| CaMax: 1506d | ENST00000229488 | | | | | | | |
| CaMax: 150a | LB4D_HUMAN | 601274 | NM_012212 | PF00107 | IPR002085 | | | LTB4DH |
| CaMax: 1516a | | | NM_017880 | | IPR000169 | | | |
| CaMax: 1519a | gp\|37589039 | | | | | | | |
| CaMax: 1519a | ENST00000311733 | | | | | | | |
| CaMax: 151b | ENST00000281131 | | | | | | | |
| CaMax: 1520a | trembl\|AY267013_1 | | | | | | | |
| CaMax: 1520a | ENST00000261435 | | | | | | | |
| CaMax: 1521b | | | NM_016147 | | IPR000734 IPR003089 IPR000639 IPR000379 | | | |
| CaMax: 1522b | trembl\|AY154463_1 | | | | | | | |
| CaMax: 1531c | trembl\|AY154463_1 | | | | | | | |
| CaMax: 1532a | trembl\|BC038422_1 | | | | | | | |
| CaMax: 1532a | ENST00000272761 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 1534b | Y373_HUMAN | | NM_014684<br>NM_025114 | PF02524 | IPR001687<br>IPR003900 | | | |
| CaMax: 1534b | Y373_BOVIN | | | | | | | |
| CaMax: 1535a | ENST00000277895 | | | | | | | |
| CaMax: 1541a | | | | | | | | |
| CaMax: 1546b | XCT_HUMAN | 607933 | NM_014331 | PF00324 | IPR004841<br>IPR002293 | | Tmhmm | SLC7A11 |
| CaMax: 1548c | ENST00000254926 | | | | | | | |
| CaMax: 1549a | ENST00000294618 | | | | | | | |
| CaMax: 1551a | | | NM_017658 | PF00651 | IPR000210 | | | BTBD5 |
| CaMax: 1554c | trembl|AB012223_1 | | | | | | | |
| CaMax: 1573a | | | NM_153689 | | | Sigp | | |
| CaMax: 1574b | trembl|AB012223_1 | | | | | | | |
| CaMax: 1574b | ENST00000310739 | | | | | | | |
| CaMax: 1577a | | 605861 | NM_014255 | | IPR000886<br>IPR008139 | Sigp | | TMEM4 |
| CaMax: 1578a | gp|34535028 | | | | | | | |
| CaMax: 157b | trembl|S77350_1 | | | | | | | |
| CaMax: 157b | ENST00000228938 | | | | | | | |
| CaMax: 1591a | gp|34849666 | | | | | | | |
| CaMax: 1591a | Transcript: ENSRNOT00000010671 | | | | | | | |
| CaMax: 1594a | ENSMUST00000060486 | | | | | | | |
| CaMax: 1596b | trembl|AF081111_2 | | | | | | | |
| CaMax: 1596b | Transcript: ENST00000319237 | | | | | | | |
| CaMax: 1598a | LIN1_NYCCO | | | | | | | |
| CaMax: 159a | trembl|CSAAE_1 | | | | | | | |
| CaMax: 159a | Transcript: ENST00000311190 | | | | | | | |
| CaMax: 15b | | | | | IPR000694 | Sigp | Tmhmm | |
| CaMax: 1602a | | | NM_018138 | | | | | |
| CaMax: 1604a | ENSDART00000024018 | | | | | | | |
| CaMax: 1626c | | | | PF00076 | IPR000504 | | | |
| CaMax: 1628d | ENST00000325761 | | | | | | | |
| CaMax: 1629a | tremblnew|BC021535_1 | | | | | | | |
| CaMax: 1629a | ENST00000229238 | | | | | | | |
| CaMax: 1630b | tremblnew|BC021535_1 | | | | | | | |
| CaMax: 1630b | ENST00000229238 | | | | | | | |
| CaMax: 1631d | | | NM_014683 | PF00069 | IPR000719<br>IPR002290<br>IPR001245 | | | ULK2 |
| CaMax: 1635a | | | NM_014683 | PF00069 | IPR000719<br>IPR002290<br>IPR001245 | | | ULK2 |
| CaMax: 1635a | | | NM_014683 | PF00069 | IPR000719<br>IPR002290<br>IPR001245 | | | ULK2 |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 1639a | pironly\|B28096 | | | | | | | |
| CaMax: 1639a | Transcript: ENST00000329369 | | | | | | | |
| CaMax: 163a | | | NM_017967 | | | | | |
| CaMax: 1646a | | | NM_015440 | PF00763 PF02882 PF01268 | IPR000559 IPR000672 | | | FTHFSDC1 |
| CaMax: 1648a | | | | PF00629 | IPR000998 | Sigp | | |
| CaMax: 164c | MI2B_HUMAN | 139111 | NM_002090 | PF00048 | IPR001089 IPR002473 IPR001811 | | | CXCL3 |
| CaMax: 1659a | trembl\|S57162_1 | | | | | | | |
| CaMax: 1659a | ENST00000316200 | | | | | | | |
| CaMax: 166a | | | NM_017887 | PF05907 | | | | |
| CaMax: 1671b | trembl\|AB012223_1 | | | | | | | |
| CaMax: 1671b | Transcript: ENST00000329369 | | | | | | | |
| CaMax: 1675a | ENST00000321491 | | | | | | | |
| CaMax: 1676a | trembl\|AF081104_2 | | | | | | | |
| CaMax: 1676a | ENST00000299933 | | | | | | | |
| CaMax: 1678a | ENST00000307746 | | | | | | | |
| CaMax: 1682a | ENSRNOT00000015118 | | | | | | | |
| CaMax: 168c | RL32_HUMAN | | | | | | | |
| CaMax: 1690a | CX41_RAT | | NM_017202 | PF02936 | IPR004203 | | | Tmhmm |
| CaMax: 1691b | | | NM_018199 | PF01612 | IPR000345 IPR002562 | | | C14orf114 |
| CaMax: 1692a | CX41_RAT | | NM_017202 | PF02936 | IPR004203 | | | Tmhmm |
| CaMax: 1693b | FGR2_HUMAN BFR2_HUMAN | 176943 101200 101600 123150 123500 | NM_022971 NM_022974 NM_022976 NM_022969 NM_022972 NM_022973 NM_000141 NM_023028 NM_023029 NM_022975 NM_022970 NM_023031 NM_023030 | PF00047 PF00069 | IPR000719 IPR001245 IPR007110 | Sigp | Tmhmm | FGFR2 |
| CaMax: 1696a | gp\|37589132 | | | | | | | |
| CaMax: 1696a | ENST00000259146 | | | | | | | |
| CaMax: 16b | ENST00000303924 | | | | | | | |
| CaMax: 1705a | CAR6_HUMAN | | NM_032587 | PF00619 | IPR001687 IPR001315 IPR001472 | | | CARD6 |
| CaMax: 1709a | Genscan: AC091966.3.1.91296.20868.46788 | | | | | | | |
| CaMax: 1714a | | | NM_018227 | PF00899 PF02134 | IPR000594 IPR000127 IPR000205 | | | |
| CaMax: 1715a | ENST00000299230 | | | | | | | |
| CaMax: 1717a | | | NM_033296 | | | | | |
| CaMax: 1721a | ILEU_HUMAN | 130135 | NM_030666 | PF00079 | IPR000215 IPR001472 | | | SERPINB1 |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 1722a | GOA4_HUMAN | 602509 270150 | NM_002078 | PF00904 PF01465 | IPR006162 IPR001990 IPR000354 IPR000237 IPR001472 | | | GOLGA4 |
| CaMax: 1724a | | | NM_153832 NM_007369 | PF00001 | IPR000276 | | Tmhmm | |
| CaMax: 1725a | ENST00000026952 | | | | | | | |
| CaMax: 1726a | trembl|AB012223_1 | | | | | | | |
| CaMax: 1726a | ENST00000325761 | | | | | | | |
| CaMax: 1727a | | 606101 | NM_032571 NM_152939 | PF01825 PF00002 PF00008 | IPR000152 IPR001881 IPR001740 IPR000832 IPR003056 IPR006209 IPR000203 | Sigp | Tmhmm | |
| CaMax: 1730a | ENST00000222271 | | | | | | | |
| CaMax: 1738b | ENST00000318296 | | | | | | | |
| CaMax: 1741a | ENST00000221700 | | | | | | | |
| CaMax: 1744a | LGR4_HUMAN | 606666 | NM_018490 | PF01462 PF00560 PF00001 | IPR007087 IPR002131 IPR000276 IPR001611 IPR000372 | Sigp | Tmhmm | GPR48 |
| CaMax: 1744a | LGR4_HUMAN | | | | | | | |
| CaMax: 174a | T2FB_HUMAN | 189969 | NM_004128 | PF02270 | IPR003196 | | | GTF2F2 |
| CaMax: 174a | T2FB_HUMAN | | | | | | | |
| CaMax: 1750a | ENST00000282228 | | | | | | | |
| CaMax: 1751a | ENST00000319353 | | | | | | | |
| CaMax: 1755a | trembl|AK051102_1 | | | | | | | |
| CaMax: 1755a | Genscan: AL109926.9.1.114298.7096.114020 | | | | | | | |
| CaMax: 1758a | RU17_HUMAN | 180740 | NM_003089 | PF00076 | IPR000504 | | | SNRP70 |
| CaMax: 1759b | | | NM_017658 | PF00651 | IPR000210 | | | BTBD5 |
| CaMax: 1760c | trembl|AX648027_1 | | | | | | | |
| CaMax: 1760c | ENST00000326555 | | | | | | | |
| CaMax: 1772a | ENSMUST00000053459 | | | | | | | |
| CaMax: 1775a | GCC1_HUMAN | 607418 | NM_024523 | PF01465 | IPR000237 | | | GCC1 |
| CaMax: 1775a | GCC1_HUMAN | 607418 | NM_024523 | PF01465 | IPR000237 | | | GCC1 |
| CaMax: 1778c | Transcript: ENST00000315390 | | | | | | | |
| CaMax: 1782b | | | | | | Sigp | Tmhmm | |
| CaMax: 178a | | 189889 | NM_005653 | PF04516 | IPR007604 IPR001472 | | | TFCP2 |
| CaMax: 1794a | gp|34527509 | | | | | | | |
| CaMax: 1794a | ENST00000310739 | | | | | | | |
| CaMax: 17a | trembl|AB012223_1 | | | | | | | |
| CaMax: 1800a | ENST00000320480 | | | | | | | |
| CaMax: 1801b | CLPX_HUMAN | | NM_006660 | PF00004 | IPR001687 IPR000345 IPR003959 | Sigp | | CLPX |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 180a | | | NM_145702 | PF04218 PF03184 | IPR004875 IPR006695 | | | TIGD1 |
| CaMax: 1810a | | | NM_025082 | | IPR001472 | | | |
| CaMax: 1811b | pironly\|B34087 | | | | | | | |
| CaMax: 1812b | SIL6_HUMAN | 604405 | NM_001245 | PF00047 | IPR003006 IPR007110 IPR001472 | Sigp | Tmhmm | SIGLEC6 |
| CaMax: 1814c | AMD_HUMAN | 170270 | NM_000919 NM_138766 NM_138822 NM_138821 | PF01082 PF03712 PF01436 | IPR002086 IPR000323 IPR000720 IPR001258 | Sigp | Tmhmm | PAM |
| CaMax: 1814c | AMD_BOVIN | | | | | | | |
| CaMax: 1818a | ENST00000324450 | | | | | | | |
| CaMax: 1828b | PLK_MOUSE | | NM_013500 | PF00047 PF00193 | IPR000538 IPR003006 | Sigp | | Crtl1 |
| CaMax: 1834b | trembl\|AY293286_1 | | | | | | | |
| CaMax: 1849d | gpnew\|37790758 | | | | | | | |
| CaMax: 1852a | Transcript: ENST00000333606 | | | | | | | |
| CaMax: 1853a | | | | | | Sigp | | |
| CaMax: 1857c | CYB5_RAT | | NM_022245 | PF00173 | IPR001199 | | Tmhmm | |
| CaMax: 1859a | | 606833 | NM_170606 NM_021230 | PF02178 PF00904 PF00628 PF00505 PF05964 PF05965 PF00856 | IPR000194 IPR000345 IPR000637 IPR000910 IPR001965 IPR001214 IPR000354 IFR001472 IPR000694 | | | MLL3 |
| CaMax: 1863c | swiss\|PEN2_HUMAN | | | | | | | |
| CaMax: 1863c | ENST00000222266 | | | | | | | |
| CaMax: 1864b | | | NM_133953 | | IPR003006 | | | 1810061H24Rik |
| CaMax: 186a | | | NM_014945 | PF00412 PF02209 | IPR001781 IPR003128 | | | |
| CaMax: 1874b | trembl\|AX648027_1 | | | | | | | |
| CaMax: 1874b | ENST00000326555 | | | | | | | |
| CaMax: 1879a | trembl\|AX648027_1 | | | | | | | |
| CaMax: 1879a | ENST00000326555 | | | | | | | |
| CaMax: 1881b | ENST00000253814 | | | | | | | |
| CaMax: 1894a | | | NM_021927 | PF00009 PF03144 PF00679 | IPR001687 IPR000795 IPR001806 IPR000640 IPR004161 | | | |
| CaMax: 18a | trembl\|AB012223_1 | | | | | | | |
| CaMax: 1912a | trembl\|BC019022_1 | | | | | | | |
| CaMax: 1912a | ENST00000318072 | | | | | | | |
| CaMax: 1913a | swiss\|COG1_HUMAN | | | | | | | |
| CaMax: 1913a | ENST00000299886 | | | | | | | |
| CaMax: 1917f | | | NM_173082 | PF00176 PF00538 PF00628 | IPR000345 IPR001841 IPR000330 | | | SHPRH |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 1919a | | | NM_080927 | PF00271 PF00431 PF03815 PF00754 | IPR001650 IPR005818 IPR001965 IPR000859 IPR000421 IPR004043 | | Tmhmm | |
| CaMax: 1920a | | | | | | | | |
| CaMax: 1928a | ENSMUST00000041864 | | | | | | | |
| CaMax: 1929c | Y539_HUMAN | | | | | | | C21orf108 |
| CaMax: 1930a | | | | PF00168 | IPR000008 | | Tmhmm | |
| CaMax: 1940e | | 604934 | NM_003193 | PF01302 PF00560 | IPR001611 IPR000938 | | | TBCE |
| CaMax: 1941e | | 606105 | NM_022109 NM_080546 | PF04515 | IPR007603 | Sigp | Tmhmm | |
| CaMax: 1943a | | 605889 | NM_014476 | PF00595 PF00412 | IPR001781 IPR001478 | | | |
| CaMax: 1944a | trembl|AK025270_1 | | | | | | | |
| CaMax: 1944a | ENST00000319557 | | | | | | | |
| CaMax: 1945a | gpnew|37748505 | | | | | | | |
| CaMax: 1945a | ENST00000312037 | | | | | | | |
| CaMax: 1948b | gpnew|37748505 | | | | | | | |
| CaMax: 1948b | ENST00000312037 | | | | | | | |
| CaMax: 1949a | gp|37590686 | | | | | | | |
| CaMax: 1949a | ENST00000320480 | | | | | | | |
| CaMax: 1950a | VAV3_HUMAN | 605541 | NM_006113 | PF00307 PF00621 PF00169 PF00130 PF00017 PF00018 | IPR002086 IPR002219 IPR001331 IPR000980 IPR001452 IPR003096 IPR001849 IPR001715 IPR000219 | | | VAV3 |
| CaMax: 1953a | NAB1_HUMAN | 600800 | NM_005966 | PF04904 PF04905 PF04902 | IPR006986 IPR006988 IPR006989 | | | NAB1 |
| CaMax: 1954e | ENST00000321787 | | | | | | | |
| CaMax: 1961e | MADI_HUMAN | 603755 | NM_007323 NM_004799 NM_007324 | PF01363 | IPR000345 IPR000306 | | | MADHIP |
| CaMax: 1967a | TAP2_HUMAN | 170261 | NM_000544 NM_018833 | PF00664 PF00005 | IPR001687 IPR003439 IPR001140 | Sigp | Tmhmm | TAP2 |
| CaMax: 1968a | | | NM_020651 | PF04710 | IPR006800 | | | PELI1 |
| CaMax: 1982a | CA1B_HUMAN | 120280 604841 154780 | NM_080629 NM_080630 NM_001854 | PF02210 PF01391 PF01410 | IPR001687 IPR001230 IPR008160 IPR000885 IPR003129 IPR001791 | Sigp | | COL11A1 |
| CaMax: 1989b | trembl|AB030650_1 | | | | | | | |
| CaMax: 1990a | | 605789 | NM_014268 | PF00307 PF03271 | IPR001715 IPR004953 | | | MAPRE2 |
| CaMax: 1991d | ENST00000244096 | | | | | | | |
| CaMax: 1a | ENST00000322438 | | | | | | | |
| CaMax: 2002c | ENSMUST00000034996 | | | | | | | |
| CaMax: 2003a | | | NM_018364 | | IPR001472 IPR000694 | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 2008a | | | NM_029522 | PF00515 PF02188 | IPR001440 IPR003109 IPR001687 | | | Pins-pending |
| CaMax: 2013a | RI14_HUMAN | 602490 | NM_003489 | | | | | NRIP1 |
| CaMax: 2014f | ENSMUST00000028222 | | | | | | | |
| CaMax: 2015e | RL4_HUMAN | 180479 | NM_000968 | PF00573 | IPR002086 IPR002136 IPR001472 | | | RPL4 |
| CaMax: 2020b | M4K3_HUMAN | 604921 | NM_003618 | PF00069 PF00780 | IPR000719 IPR001180 | | | MAP4K3 |
| CaMax: 2020b | M4K3_MOUSE | | | | | | | |
| CaMax: 2022a | | | NM_015589 | PF00536 | IPR001660 | Sigp | | SAMD4 |
| CaMax: 2023b | trembl\|BT008100_1 | | | | | | | |
| CaMax: 2023b | ENST00000312547 | | | | | | | |
| CaMax: 2024a | ENST00000314543 | | | | | | | |
| CaMax: 2034a | | | NM_178352 | | IPR003267 | | | |
| CaMax: 2035d | RPCZ_HUMAN | 606007 | NM_016310 | PF02150 PF01096 | IPR001222 IPR001529 | | | POLR3K |
| CaMax: 204a | ENST00000276230 | | | | | | | |
| CaMax: 2056d | HELZ_HUMAN | 606699 | NM_014877 | PF00642 | IPR001687 IPR000571 | | | HELZ |
| CaMax: 2059b | ENST00000282218 | | | | | | | |
| CaMax: 205a | ENST00000276230 | | | | | | | |
| CaMax: 2070a | | | NM_016081 | PF00047 | IPR000634 IPR007110 IPR002965 IPR000694 | | | |
| CaMax: 2073b | trembl\|AB012223_1 | | | | | | | |
| CaMax: 2073b | Transcript: ENST00000320621 | | | | | | | |
| CaMax: 2074b | A8A1_HUMAN | | NM_006095 | PF00702 PF00122 | IPR001687 IPR001757 IPR008250 IPR005834 | | Tmhmm | ATP8A1 |
| CaMax: 2075a | | | NM_178043 NM_032239 NM_018078 | PF05383 | IPR001199 | | | |
| CaMax: 2076c | ENST00000324643 | | | | | | | |
| CaMax: 2078a | SEP7_HUMAN | 603151 | NM_001788 | PF00735 | IPR001687 IPR000038 | | | CDC10 |
| CaMax: 2083e | | | NM_020830 NM_178350 | PF00400 PF01363 | IPR001680 IPR000306 | | | WDFY1 |
| CaMax: 2088a | | | NM_182543 | PF01189 | IPR001678 | | | |
| CaMax: 2092c | gpnew\|37790758 | | | | | | | |
| CaMax: 2095a | ENST00000258969 | | | | | | | |
| CaMax: 2099a | swissnew\| SF30_HUMAN | | | | | | | |
| CaMax: 2099a | ENST00000239010 | | | | | | | |
| CaMax: 20a | trembl\|BC001284_1 | | | | | | | |
| CaMax: 20a | ENST00000318446 | | | | | | | |
| CaMax: 2100b | FBN1_HUMAN | 134797 154700 | NM_000138 | PF00008 PF00683 | IPR000152 IPR006209 IPR007087 IPR001881 IPR001438 IPR002212 | Sigp | | FBN1 |
| CaMax: 2105a | ENST00000319412 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 2108b | Transcript: ENST00000314393 | | | | | | | |
| CaMax: 2109a | ENST00000324450 | | | | | | | |
| CaMax: 2110a | Z345_HUMAN | | NM_003419 | PF00096 | IPR007087 IPR007086 | | | ZNF345 |
| CaMax: 2113a | ENST00000324450 | | | | | | | |
| CaMax: 211b | MRP1_HUMAN | 158343 | NM_004996 NM_019901 NM_019902 NM_019898 NM_019862 NM_019900 NM_019899 | PF00664 PF00005 | IPR001687 IPR000719 IPR003439 IPR001140 | | Tmhmm | ABCC1 |
| CaMax: 2122a | ENST00000321873 | | | | | | | |
| CaMax: 2123a | | | NM_145648 | PF00854 | IPR001117 IPR000109 | | Tmhmm | SLC15A4 |
| CaMax: 2129a | | | NM_020239 | PF00786 | IPR000095 | | | |
| CaMax: 2132a | ENST00000175091 | | | | | | | |
| CaMax: 2135d | ENST00000325604 | | | | | | | |
| CaMax: 2136b | ENST00000294665 | | | | | | | |
| CaMax: 2141a | ENSMUST00000000642 | | | | | | | |
| CaMax: 2142a | Genscan: CAAA01004319.1.1.45274.2016.41736 | | | | | | | |
| CaMax: 2160a | ENST00000285599 | | | | | | | |
| CaMax: 2161c | | | NM_178043 NM_032239 NM_018078 | PF05383 | IPR001199 | | | |
| CaMax: 2165a | ENST00000244769 | | | | | | | |
| CaMax: 2167a | ENST00000278483 | | | | | | | |
| CaMax: 2189b | ENST00000309655 | | | | | | | |
| CaMax: 2198b | ENSMUST00000000642 | | | | | | | |
| CaMax: 2201a | ENST00000244769 | | | | | | | |
| CaMax: 2201a | ENST00000244769 | | | | | | | |
| CaMax: 2205a | ENST00000274054 | | | | | | | |
| CaMax: 2210a | ENST00000244769 | | | | | | | |
| CaMax: 2222b | | | | PF00168 | IPR000008 | | Tmhmm | |
| CaMax: 2223a | Transcript: ENST00000228330 | | | | | | | |
| CaMax: 2224a | | 604283 | NM_005807 | PF01033 PF05001 PF02818 PF00045 | IPR000585 IPR001212 IPR002965 IPR004168 IPR000684 IPR001472 | Sigp | | PRG4 |
| CaMax: 2225b | | | | PF01436 | IPR001258 IPR006663 | | | |
| CaMax: 2234a | TRFR_MOUSE | | NM_013696 | PF00001 | IPR000276 IPR002120 | | Tmhmm | Trhr |
| CaMax: 2235a | ENST00000296412 | | | | | | | |
| CaMax: 2235a | ENST00000296412 | | | | | | | |
| CaMax: 2238a | CN3A_HUMAN | 123805 | NM_000921 | PF00233 | IPR002073 IPR005829 IPR001917 | | Tmhmm | PDE3A |
| CaMax: 2241a | CN3A_HUMAN | 123805 | NM_000921 | PF00233 | IPR002073 IPR005829 IPR001917 | | Tmhmm | PDE3A |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 2238a | CN3A_HUMAN | 123805 | NM_000921 | PF00233 | IPR002073 IPR005829 IPR001917 | | Tmhmm | PDE3A |
| CaMax: 224a | trembl|HSF8L1B_1 | | | | | | | |
| CaMax: 2251d | swiss|LIN1_NYCCO | | | | | | | |
| CaMax: 2252b | | | NM_018359 | | | | | |
| CaMax: 2258a | ENST00000245479 | | | | | | | |
| CaMax: 2258a | ENST00000245479 | | | | | | | |
| CaMax: 2258a | ENST00000245479 | | | | | | | |
| CaMax: 225a | gp|37361816 | | | | | | | |
| CaMax: 2264b | ENSMUST00000000642 | | | | | | | |
| CaMax: 2264b | ENSMUST00000000642 | | | | | | | |
| CaMax: 2266b | ENST00000306715 | | | | | | | |
| CaMax: 2267a | TSP1_HUMAN | 188060 | NM_003246 | PF02210 PF00093 PF00090 PF00008 PF02412 PF05735 | IPR006209 IPR001007 IPR000884 IPR003129 IPR003367 IPR001791 | Sigp | | THBS1 |
| CaMax: 231a | ENST00000317584 | | | | | | | |
| CaMax: 2331c | ENST00000296412 | | | | | | | |
| CaMax: 2341b | | | | | | | | |
| CaMax: 2351c | ENST00000319965 | | | | | | | |
| CaMax: 2351c | ENST00000319965 | | | | | | | |
| CaMax: 2241a | CN3A_HUMAN | 123805 | NM_000921 | PF00233 | IPR002073 IPR005829 IPR001917 | | Tmhmm | PDE3A |
| CaMax: 235a | Genscan: RNOR01069968.11947.48582 | | | | | | | |
| CaMax: 2374a | TSP1_HUMAN | 188060 | NM_003246 | PF02210 PF00093 PF00090 PF00008 PF02412 PF05735 | IPR006209 IPR001007 IPR000884 IPR003129 IPR003367 IPR001791 | Sigp | | THBS1 |
| CaMax: 238a | Genscan: AC016601.7.1.145264.1553.20016 | | | | | | | |
| CaMax: 239a | SPCN_HUMAN | 182810 | NM_003127 | PF00435 PF00018 PF00036 | IPR002048 IPR000276 IPR001452 IPR002017 | | | SPTAN1 |
| CaMax: 23a | GME1_HUMAN | 604409 | NM_006582 NM_024482 | PF01342 | IPR000770 | | | GMEB1 |
| CaMax: 240a | | | NM_032811 | PF05964 PF05965 | | | | |
| CaMax: 243a | trembl|AB012223_1 | | | | | | | |
| CaMax: 245a | | | NM_144972 | PF00056 PF02866 | IPR001557 IPR001236 IPR000205 IPR000594 | | | |
| CaMax: 248a | | | NM_018211 | PF00076 | IPR000504 IPR001064 | | | |
| CaMax: 24a | ENST00000239392 | | | | | | | |
| CaMax: 258a | gpnew|37790758 | | | | | | | |
| CaMax: 261c | gp|37361850 | | | | | | | |
| CaMax: 261c | ENST00000322543 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 267d | TENA_HUMAN | 187380 | NM_002160 | PF00008 PF00041 PF00147 | IPR006209 IPR002049 IPR003961 IPR002181 | Sigp | Tmhmm | TNC |
| CaMax: 272d | | | NM_018696 | PF00753 | IPR001279 | | | ELAC1 |
| CaMax: 27a | ENSRNOT00000006484 | | | | | | | |
| CaMax: 28s | Genscan: NA26110.1.701.1515 | | | | | | | |
| CaMax: 307b | YCE7_HUMAN | | NM_016077 | PF01981 | IPR002833 | Sigp | Tmhmm | |
| CaMax: 308c | | 180069 | NM_000329 | PF03055 | IPR004294 | | | RPE65 |
| CaMax: 310h | M172_MOUSE | | | | | | | |
| CaMax: 311c | ENST00000315874 | | | | | | | |
| CaMax: 313a | Genscan: AL136225.8.1.42171.4910.17211 | | | | | | | |
| CaMax: 314a | ENST00000303575 | | | | | | | |
| CaMax: 319b | ENSRNOT00000022117 | | | | | | | |
| CaMax: 320a | SEC3_HUMAN | 607879 | NM_018261 NM_178237 | | | | | |
| CaMax: 320a | SEC3_HUMAN | | | | | | | |
| CaMax: 322a | ENSRNOT00000022117 | | | | | | | |
| CaMax: 324a | | | NM_020935 | PF00443 PF02809 | IPR001394 IPR003903 | | | USP37 |
| CaMax: 326e | SPC4_MOUSE | | NM_019951 | PF00461 | IPR000508 IPR001733 | Sigp | Tmhmm | Spc18-pending |
| CaMax: 327f | gp\|37360062 | | | | | | | |
| CaMax: 327f | ENST00000315821 | | | | | | | |
| CaMax: 328b | | | NM_016081 | PF00047 | IPR000634 IPR007110 IPR002965 IPR000694 | | | |
| CaMax: 336a | | | | | | | | |
| CaMax: 33a | trembl\|BC024093_1 | | | | | | | |
| CaMax: 33a | ENSRNOT00000006836 | | | | | | | |
| CaMax: 340a | swiss\|PTN3_HUMAN | | | | | | | |
| CaMax: 340a | ENST00000262539 | | | | | | | |
| CaMax: 343b | trembl\|AK033094_1 | | | | | | | |
| CaMax: 343b | ENST00000269073 | | | | | | | |
| CaMax: 34a | gp\|34534817 | | | | | | | |
| CaMax: 34a | ENST00000316410 | | | | | | | |
| CaMax: 106a | FRIH_HUMAN | 134770 | NM_002032 | PF00210 | IPR001519 | | | FTH1 |
| CaMax: 106a | FRIH_HUMAN | 134770 | NM_002032 | PF00210 | IPR001519 | | | FTH1 |
| CaMax: 360a | tremblnew\| AK094461_1 | | | | | | | |
| CaMax: 360a | ENST00000291220 | | | | | | | |
| CaMax: 364a | EWS_HUMAN | 133450 | NM_005243 NM_013986 | PF00076 PF00641 | IPR001064 IPR000504 IPR001876 | | | EWSR1 |
| CaMax: 370a | COX1_CANFA | | | | | | | |
| CaMax: 374a | A32B_HUMAN | | NM_006401 | PF00560 | IPR001611 | | | ANP32B |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 375d | COX1_CANFA | | | | | | | |
| CaMax: 379a | ENST00000278407 | | | | | | | |
| CaMax: 38a | | 607686 | NM_030917 | PF05182 | IPR007854 | | | FIP1L1 |
| CaMax: 391a | ENST00000293648 | | | | | | | |
| CaMax: 392a | trembInew\|BC034135_1 | | | | | | | |
| CaMax: 392a | ENST00000319311 | | | | | | | |
| CaMax: 395a | trembl\|BC051886_1 | | | | | | | |
| CaMax: 395a | ENST00000323751 | | | | | | | |
| CaMax: 397b | ALU7_HUMAN | | | | | | | |
| CaMax: 3c | | | | | | | | |
| CaMax: 406a-r | swiss\|COX3_CANFA | | | | | | | |
| CaMax: 406a-r | Transcript: :ENST00000332194 | | | | | | | |
| CaMax: 408a | ALU1_HUMAN | | | | | | | |
| CaMax: 409a | ALU1_HUMAN | | | | | | | |
| CaMax: 415b | IF2A_HUMAN | 603907 | NM_004094 | PF00575 | IPR003029 | | | EIF2S1 |
| CaMax: 421a | gpnew\|37790758 | | | | | | | |
| CaMax: 43a | | | | | IPR000694 | Sigp | Tmhmm | |
| CaMax: 446f | ENST00000239392 | | | | | | | |
| CaMax: 44c | trembl\|AK019226_1 | | | | | | | |
| CaMax: 44c | ENST00000264258 | | | | | | | |
| CaMax: 45.1b | trembl\|AK007837_1 | | | | | | | |
| CaMax: 45.1b | ENST00000314138 | | | | | | | |
| CaMax: 450a | trembInew\|HSM805132_1 | | | | | | | |
| CaMax: 450a | ENST00000325086 | | | | | | | |
| CaMax: 452a | ENST00000218713 | | | | | | | |
| CaMax: 455c | trembl\|BC028178_1 | | | | | | | |
| CaMax: 455c | ENST00000317856 | | | | | | | |
| CaMax: 457c | trembl\|HSU93569_1 | | | | | | | |
| CaMax: 459a | NFT5_HUMAN | 604708 | NM_006599 NM_138713 NM_138714 NM_173214 NM_173215 | PF00554 PF01833 | IPR000451 IPR002909 IPR001472 | | | NFAT5 |
| CaMax: 461a | swissnew\|SF30_HUMAN | | | | | | | |
| CaMax: 461a | ENST00000239010 | | | | | | | |
| CaMax: 464b | PURA_HUMAN | 103060 | NM_001126 | PF00709 | IPR001114 | | | ADSS |
| CaMax: 465b | | | NM_016952 | PF00047 PF00041 | IPR003961 IPR007110 | | Tmhmm | CDON |
| CaMax: 46a | ENST00000282493 | | | | | | | |
| CaMax: 472a | trembInew\|BC019810_1 | | | | | | | |
| CaMax: 472a | ENST00000327301 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 478a | TCTL_HUMAN | 300302 | NM_006520 | PF03645 | IPR005334 | | | TCTE1L |
| CaMax: 479c | TCTL_HUMAN | 300302 | NM_006520 | PF03645 | IPR005334 | | | TCTE1L |
| CaMax: 482a | Genscan: AP005117.2.1.148790.13386.95160 | | | | | | | |
| CaMax: 487a | ARH2_HUMAN | 607560 | NM_004723 | PF00130 PF00621 PF00169 | IPR002219 IPR001849 IPR000219 | | | ARHGEF2 |
| CaMax: 488a | HXK2_HUMAN | 601125 | NM_000189 | PF00349 PF03727 | IPR001312 | | | HK2 |
| CaMax: 48b | trembl\|AK019226_1 | | | | | | | |
| CaMax: 48b | ENST00000264258 | | | | | | | |
| CaMax: 490c | trembl\|AK088660_1 | | | | | | | |
| CaMax: 490c | ENSRNOT00000025796 | | | | | | | |
| CaMax: 494a | trembl\|HSAB461_1 | | | | | | | |
| CaMax: 494a | ENST00000324722 | | | | | | | |
| CaMax: 498a | ENSRNOT00000011463 | | | | | | | |
| CaMax: 50.1c | swiss\|RL31_HUMAN | | | | | | | |
| CaMax: 50.1c | ENST00000264258 | | | | | | | |
| CaMax: 501b | ENSMUST00000050981 | | | | | | | |
| CaMax: 504a | ENST00000267434 | | | | | | | |
| CaMax: 505b | ENST00000248673 | | | | | | | |
| CaMax: 507a | ENSRNOT00000016310 | | | | | | | |
| CaMax: 516c | Transcript: ENST00000328854 | | | | | | | |
| CaMax: 517c | Transcript: ENST00000328854 | | | | | | | |
| CaMax: 51a | trembl\|AY072691_1 | | | | | | | |
| CaMax: 51a | ENST00000321758 | | | | | | | |
| CaMax: 520a | | | NM_017658 | PF00651 | IPR000210 | | | BTBD5 |
| CaMax: 521b | MEFC_HUMAN | 600662 | NM_002397 | PF00319 | IPR002100 | | | MEF2C |
| CaMax: 523a | ENST00000300162 | | | | | | | |
| CaMax: 52a | ENST00000242208 | | | | | | | |
| CaMax: 530b | PSA3_HUMAN | 176843 176845 | NM_152132 NM_002788 | PF00227 | IPR000426 IPR001353 | | | PSMA3 |
| CaMax: 538a | ENST00000283629 | | | | | | | |
| CaMax: 539a | | | | PF00069 | IPR000719 IPR002290 IPR001245 | | | |
| CaMax: 540a | pironly\|JU0033 | | | | | | | |
| CaMax: 543a | gp\|34533874 | | | | | | | |
| CaMax: 545a | | | 605861 NM_014255 | | IPR000886 IPR008139 | Sigp | | TMEM4 |
| CaMax: 547c | | | NM_014827 | PF00642 | IPR000571 IPR001472 | | | |
| CaMax: 548c | | | NM_014827 | PF00642 | IPR000571 IPR001472 | | | |
| CaMax: 550a | | 605975 | NM_005839 | PF01480 | IPR002965 IPR002483 IPR001472 | | | SRRM1 |
| CaMax: 552a | ENST00000318468 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 553b | | | NM_031208 | PF01557 | IPR002529 | | | |
| CaMax: 555b | | 605653 | NM_012158 | PF00646 | IPR001810 | | | FBXL3A FBXL3B |
| CaMax: 556b | tremblnew\|HSM805356_1 | | | | | | | |
| CaMax: 557b | NSF_HUMAN | | | | | | | |
| CaMax: 558a | trembl\|AF352051_1 | | | | | | | |
| CaMax: 558a | ENST00000319272 | | | | | | | |
| CaMax: 560b | RBB2_HUMAN | | | | | | | |
| CaMax: 561b | ENST00000296499 | | | | | | | |
| CaMax: 568a | trembl\|CFA388522_1 | | | | | | | |
| CaMax: 568a | ENST00000225430 | | | | | | | |
| CaMax: 56a | gpnew\|38511552 | | | | | | | |
| CaMax: 56a | ENST00000202773 | | | | | | | |
| CaMax: 571a | EML4_HUMAN | 607442 | NM_019063 | PF03451 PF00400 | IPR002048 IPR001254 IPR001680 IPR000560 IPR005108 | | | EML4 |
| CaMax: 574a | ENST00000296412 | | | | | | | |
| CaMax: 579a | SFR6_HUMAN | 601944 | NM_006275 | PF00076 | IPR000504 IPR001472 | | | SFRS6 |
| CaMax: 57a | ITA6_HUMAN | 147556 226730 | NM_000210 | PF01839 PF00357 | IPR000413 | Sigp | Tmhmm | ITGA6 |
| CaMax: 581a | | | NM_014553 | PF04516 | IPR007604 | | | |
| CaMax: 583e | | | | PF00039 PF00041 | IPR006209 IPR000083 IPR002086 IPR003962 IPR003961 | | | Fn1 |
| CaMax: 58a | ENST00000313783 | | | | | | | |
| CaMax: 597c | FALZ_HUMAN | 601819 | NM_182641 NM_004459 | PF02791 PF00628 PF00439 | IPR001687 IPR000345 IPR001487 IPR006209 IPR001965 IPR004022 IPR000694 | | | FALZ |
| CaMax: 59a | swissnew\|SMO2_MOUSE | | | | | | | |
| CaMax: 59a | ENST00000230324 | | | | | | | |
| CaMax: 609a | Genscan: RNOR01094784.3716.7206 | | | | | | | |
| CaMax: 611a | Transcript: ENST00000256653 | | | | | | | |
| CaMax: 622a | gp\|34532352 | | | | | | | |
| CaMax: 622a | Genscan: AC107939.5.1.145264.83212.131724 | | | | | | | |
| CaMax: 623a | IQG1_HUMAN | 603379 | NM_003870 | PF00307 PF00397 PF00612 PF00616 PF03836 | IPR001936 IPR001202 IPR001715 IPR000048 IPR000593 | | | IQGAP1 |
| CaMax: 624b | ENSMUST00000058265 | | | | | | | |
| CaMax: 626a | trembl\|BC046507_1 | | | | | | | |
| CaMax: 626a | ENST00000261631 | | | | | | | |
| CaMax: 628a | KRM1_HUMAN | | NM_153379 NM_032045 | PF00431 | IPR000859 | | Tmhmm | KREMEN1☐ |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 635a | | 605975 | NM_005839 | PF01480 | IPR002965 IPR002483 IPR001472 | | | SRRM1 |
| CaMax: 638b | TCTL_HUMAN | 300302 | NM_006520 | PF03645 | IPR005334 | | | TCTE1L |
| CaMax: 639a | ENST00000309558 | | | | | | | |
| CaMax: 63a | trembl\|AY259036_1 | | | | | | | |
| CaMax: 63a | Transcript: ENST00000332194 | | | | | | | |
| CaMax: 64.2a | Y121_HUMAN | | | | | | | |
| CaMax: 685a | U183_HUMAN | | NM_025187 | PF03676 | IPR005373 | | | |
| CaMax: 690a | ENST00000244411 | | | | | | | |
| CaMax: 690a | ENST00000244411 | | | | | | | |
| CaMax: 692a | | | NM_145702 | PF04218 | IPR004875 | | | TIGD1 |
| CaMax: 697a | | | | PF03184 PF00443 | IPR006695 IPR005479 IPR001394 | | | |
| CaMax: 6b | Z216_MOUSE | | | | | | | |
| CaMax: 701a | | | NM_146000 | | IPR001472 | | | D030060M11Rik |
| CaMax: 704b | | 243305 | NM_014425 | PF00023 PF00612 | IPR002110 IPR000048 | | | INVS |
| CaMax: 704b | | 243305 | NM_014425 | PF00023 PF00612 | IPR002110 IPR000048 | | | INVS |
| CaMax: 70d | ENST00000323467 | | | | | | | |
| CaMax: 710a | CA1A_HUMAN | 120110 156500 184250 | NM_000493 | PF01391 PF00386 | IPR001073 IPR008160 | Sigp | | COL10A1 |
| CaMax: 711a | trembl\|AK019226_1 | | | | | | | |
| CaMax: 711a | ENST00000264258 | | | | | | | |
| CaMax: 713a | trembl\|BC008338_1 | | | | | | | |
| CaMax: 713a | ENST00000012559 | | | | | | | |
| CaMax: 714a | Genscan: AL391495.16.1.142952.28457.34558 | | | | | | | |
| CaMax: 718a | ENST00000299020 | | | | | | | |
| CaMax: 720a | NU4M_CANFA | | | | | | | |
| CaMax: 725a | | | | PF00063 PF00612 | IPR001687 IPR001609 IPR000048 | | | |
| CaMax: 726b | GDC_HUMAN | 139080 | NM_152707 | PF00153 | IPR001993 IPR002167 IPR002067 | | | SLC25A16 |
| CaMax: 72a | trembl\|AK007442_1 | | | | | | | |
| CaMax: 72a | ENST00000250454 | | | | | | | |
| CaMax: 731a | trembl\|HSDNAW_1 | | | | | | | |
| CaMax: 731a | ENST00000275603 | | | | | | | |
| CaMax: 736a | ATDA_HUMAN | 313020 | NM_002970 | PF00583 | IPR000182 | | | SAT |
| CaMax: 739a | | | NM_133375 | PF00773 | IPR001900 | | | |
| CaMax: 73b | KE4_HUMAN | 601416 | NM_006979 | PF02535 | IPR002395 IPR003689 | Sigp | Tmhmm | HKE4 |
| CaMax: 745a | ENST00000315919 | | | | | | | |
| CaMax: 747a | | | NM_133433 NM_015384 | | | | | |
| CaMax: 749a | ENST00000294890 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 74c | ENSRNOT00000020282 | | | | | | | |
| CaMax: 753b | | | NM_025685 | PF01410 | IPR000885 | | | 5730512J02Rik |
| CaMax: 759b | trembl\|AX704781_1 | | | | | | | |
| CaMax: 759b | ENST00000261981 | | | | | | | |
| CaMax: 764b | trembl\|AK002413_1 | | | | | | | |
| CaMax: 764b | ENSRNOT00000005190 | | | | | | | |
| CaMax: 765a | | | | | IPR001687 | | | |
| CaMax: 768a | ENST00000325727 | | | | | | | |
| CaMax: 76b | ENST00000275248 | | | | | | | |
| CaMax: 785b | PRIO_HUMAN | 176640 123400 600072 137440 603218 245300 606688 | NM_000311 | PF03991 PF00377 | IPR000817 | Sigp | Tmhmm | PRNP |
| CaMax: 788a | ENSMUST00000029203 | | | | | | | |
| CaMax: 789a | | | | | | | Tmhmm | NDFIP2 |
| CaMax: 794a | SSPN_HUMAN | 601599 | NM_005086 | | | | Tmhmm | SSPN |
| CaMax: 795a | | | NM_017812 | PF05300 | IPR007964 | | | |
| CaMax: 810a | Y379_HUMAN | | | PF00023 | IPR002110 | | | |
| CaMax: 813a | ENST00000222567 | | | | | | | |
| CaMax: 815a | Transcript: ENST00000272273 | | | | | | | |
| CaMax: 81a | ENST00000252102 | | | | | | | |
| CaMax: 820a | trembl\|AB012223_1 | | | | | | | |
| CaMax: 820a | ENST00000325761 | | | | | | | |
| CaMax: 827b | trembl\|AX147999_1 | | | | | | | |
| CaMax: 827b | ENST00000269485 | | | | | | | |
| CaMax: 828a | ENST00000265264 | | | | | | | |
| CaMax: 82b | ENST00000252102 | | | | | | | |
| CaMax: 831a | trembl\|AK019226_1 | | | | | | | |
| CaMax: 831a | ENST00000264258 | | | | | | | |
| CaMax: 832a | | | | PF00039 PF00041 | IPR006209 IPR000083 IPR002086 IPR003962 IPR003961 | | | Fn1 |
| CaMax: 833a | | 607838 | NM_032520 | | | Sigp | | |
| CaMax: 835c | LIN1_NYCCO | | | | | | | |
| CaMax: 839a | | | | PF00400 | IPR001680 | | | |
| CaMax: 841b | trembl\|AY072691_1 | | | | | | | |
| CaMax: 841b | ENST00000321758 | | | | | | | |
| CaMax: 847a | trembl\|AY170044_1 | | | | | | | |
| CaMax: 85.1c | | | NM_014301 | PF01592 | IPR002871 | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 85.2b | | | | | | Sigp | Tmhmm | |
| CaMax: 850a | Genscan: AP000813.4.1.210816.38383.42179 | | | | | | | |
| CaMax: 851a | Genscan: AP000813.4.1.210816.38383.42179 | | | | | | | |
| CaMax: 856c | BCAT_HUMAN | 113520 | NM_005504 | PF01063 | IPR001544 | | | BCAT1 |
| CaMax: 863c | SLUG_MOUSE | | NM_011415 | PF00096 | IPR007087 IPR007086 | | | Snai2 |
| CaMax: 890a | RB6A_HUMAN | 179513 | NM_002869 | PF00071 | IPR001687 IPR001806 | | | RAB6A |
| CaMax: 8a | ENST00000254942 | | | | | | | |
| CaMax: 905a | ENST00000231061 | | | | | | | |
| CaMax: 906a | gpnew|37790758 | | | | | | | |
| CaMax: 907a | MANR_HUMAN | | | | | | | |
| CaMax: 909a | AMD_HUMAN | 170270 | NM_000919 NM_138766 NM_138822 NM_138821 | PF01082 PF03712 PF01436 | IPR002086 IPR000323 IPR000720 IPR001258 | Sigp | Tmhmm | PAM |
| CaMax: 90c | HS9B_MOUSE | | NM_008302 | PF02518 PF00183 | IPR001404 IPR003594 | | | Hspcb |
| CaMax: 911a | trembl|AB012223_1 | | | | | | | |
| CaMax: 911a | ENST00000292530 | | | | | | | |
| CaMax: 912b | gp|34535483 | | | | | | | |
| CaMax: 914a | gp|34534229 | | | | | | | |
| CaMax: 914a | ENST00000273342 | | | | | | | |
| CaMax: 915a | swiss|ALU6_HUMAN | | | | | | | |
| CaMax: 915a | ENST00000262877 | | | | | | | |
| CaMax: 919b | | | NM_016132 | PF00076 | IPR000504 | | | MYEF2 |
| CaMax: 91f | trembl|S78694_1 | | | | | | | |
| CaMax: 91f | ENST00000231004 | | | | | | | |
| CaMax: 919b | | | NM_016132 | PF00076 | IPR000504 | | | MYEF2 |
| CaMax: 92c | | 602691 | NM_147233 NM_003743 NM_147223 | PF00010 PF00989 | IPR001092 IPR000014 IPR001472 | | | NCOA1 |
| CaMax: 935b | CHUR_HUMAN | | NM_145165 | | IPR000345 | | | C14orf52 |
| CaMax: 936b | trembl|BT008233_1 | | | | | | | |
| CaMax: 936b | ENST00000316232 | | | | | | | |
| CaMax: 945a | | | | PF00076 | IPR000504 | | | |
| CaMax: 947a | trembl|AY310153_1 | | | | | | | |
| CaMax: 947a | ENSRNOT00000005605 | | | | | | | |
| CaMax: 949c | | | NM_152396 | | IPR001601 IPR000051 | | | |
| CaMax: 953a | 68MP_MOUSE | | NM_027360 | | | | Tmhmm | 2010107E04Rik |
| CaMax: 963c | | 607204 | NM_014676 | PF00806 | IPR001313 | | | PUM1 |
| CaMax: 96e | RL32_HUMAN | | | | | | | |
| CaMax: 981a | gpnew|37790758 | | | | | | | |
| CaMax: 984a | pironly|JC7185 | | | | | | | |

TABLE 2B-continued

| CaMax Gene ID | Swissprot Ensemble | OMIM | RefSeq | Pfam | InterPro | Sig. Pep. | TMHMM | HUGO |
|---|---|---|---|---|---|---|---|---|
| CaMax: 984a | ENSMUST00000048377 | | | | | | | |
| CaMax: 986a | CGD2_HUMAN | 123833 | NM_001759 | PF00134 PF02984 | IPR006671 IPR004367 | | | CCND2 |
| CaMax: 990a | SOX9_HUMAN | 114290 | NM_000346 | PF00505 | IPR000910 IPR001472 | | | SOX9 |
| CaMax: 992a | tremblnew|AK096400_1 | | | | | | | |
| CaMax: 994b | | 606457 | NM_015525 | PF00023 PF00415 PF00651 | IPR001687 IPR000405 IPR002110 IPR000210 | | | |
| CaMax: 996a | RS20_HUMAN | 603682 | NM_001023 | PF00338 | IPR001687 IPR001848 | | | RPS20 |

One embodiment of the invention relates to a combination comprising two or more polynucleotide molecules selected from SEQ ID NOs:1-1558, or fragments thereof. Preferably, the combination comprises about 10 or more polynucleotide molecules, more preferably about 50 or more polynucleotide molecules, more preferably about 200 or more polynucleotide molecules, more preferably about 400 or more polynucleotide molecules, more preferably about 1000 or more polynucleotide molecules.

In a preferred embodiment, the invention relates to a combination of 396 differentially expressed polynucleotide molecules, whose sequences are represented by SEQ ID NOs:1-396. Table 3 identifies a list of gene sequences determined from clinical samples to be differentially expressed in OA versus normal subjects to a degree that is statistically significant ($p<0.05$). Table 3 includes the gene IDs, expression values, standard deviations, and fold difference of expression (OA versus normal). Preferably, the combination comprises two or more of polynucleotide molecules selected from SEQ ID NOs:1-396 or fragments thereof.

In a particularly preferred embodiment, the invention relates to a combination of 217 differentially expressed polynucleotide molecules, whose sequences are represented by SEQ ID NOs:1-217. Table 4 identifies a list of gene sequences determined from clinical samples to be differentially expressed in OA versus normal subjects to a degree that is highly significant ($p<0.01$). Table 4 includes the gene IDs, expression values, standard deviations, and fold difference of expression (OA versus normal). Preferably, the combination comprises two or more of polynucleotide molecules selected from SEQ ID NOs:1-217 or fragments thereof.

According to an aspect of the invention, one or more oligonucleotide or polynucleotide probes for interrogating a sample may be prepared using the sequence information set forth herein for any of the 1558 isolated gene fragments (SEQ ID NOs:1-1558). According to another aspect of the invention, probes may be prepared using the sequence information available for any of the genes or gene fragments identified in. The probes should be of sufficient length to specifically hybridize substantially exclusively with appropriate complementary genes or transcripts. Preferably, the oligonucleotide probes will be at least about 10, 12, 14, 16, 18, 20 or 25 nucleotides in length. In some embodiments, longer probes of at least about 30, 40, 50, 60, 70, 80, 90 or 100 nucleotides are desirable, and probes longer than about 100 nucleotides may be suitable in some embodiments. Preferably, a collection of two or more nucleic acid probes for detecting expression of gene products differentially expressed in OA is provided, more preferably a collection of about 10 or more probes, more preferably a collection of about 50 or more probes, more preferably a collection of about 200 or more probes, more preferably a collection of about 400 or more probes, more preferably a collection of about 1000 or more probes.

In a preferred embodiment of the invention, one or more oligonucleotide or polynucleotide probes may be prepared using the sequence information set forth for any of SEQ ID NOs:1-396. Preferably, one or more oligonucleotide or polynucleotide probes may be prepared using the sequence information set forth for any of SEQ ID NOs:1-217.

In certain preferred embodiments of the present invention, immobilized nucleic acid probes may be used for the rapid and specific detection of nucleic acid molecules and their expression patterns. Typically, a nucleic acid probe is linked to a solid support and a target nucleic acid (e.g., a genomic nucleic acid, an amplicon, or, most commonly, an amplified mixture) is hybridized to the probe. Either the probe, or the target, or both, can be labeled, typically with a fluorophore or other tag, such as streptavidin. Where the target is labeled, hybridization may be detected by detecting bound fluorescence. Where the probe is labeled, hybridization is typically detected by quenching of the label. Where both the probe and the target are labeled, detection of hybridization is typically performed by monitoring a color shift resulting from proximity of the two bound labels. A variety of labeling strategies, labels, and the like, particularly for fluorescent based applications, are known in the art.

Another aspect of the invention relates to one or more probes comprising polypeptide binding agents that specifically bind to polypeptides produced by expression of one or more nucleic acid molecules comprising sequences selected from SEQ ID NOs:1-1558 or fragments thereof. According to another aspect of the invention, protein binding probes may be prepared using the sequence information available for any of the genes or gene fragments identified in Table 2. Preferably, a collection of two or more polypeptide probes for detecting expression of gene products differentially expressed in OA is provided, more preferably a collection of about 10 or more probes, more preferably a collection of about 50 or more probes, more preferably a collection of about 200 or more probes, more preferably a collection of about 400 or more probes, more preferably a collection of about 1000 or more probes.

In a preferred embodiment of the invention, probes comprising polypeptide binding agents specifically bind to polypeptides produced by nucleic acid molecules comprising sequences selected from SEQ ID NOs:1-396. In a particularly preferred embodiment, probes comprising polypeptide binding agents specifically bind to polypeptides produced by nucleic acid molecules comprising sequences selected from SEQ ID NOs:1-217.

Assay techniques that can be used to determine levels of a protein in a sample are also well known to those of skill in the art. Such assay methods include radioimmunoassays, competitive-binding assays, Western blot analysis and ELISA assays. In the assay methods utilizing antibodies, both polyclonal and monoclonal antibodies are suitable for use in the present invention. Such antibodies may be immunologically specific for a particular protein, or an epitope of the protein, or a protein fragment, as would be well understood by those of skill in the art. Methods of making polyclonal and monoclonal antibodies immunologically specific for a protein or peptide are also well known in the art.

Preferred embodiments of the present invention may utilize antibodies for the detection and quantification of proteins produced by expression of the polynucleotides described herein. Though proteins may be detected by immunoprecipitation, affinity separation, Western blot analysis and the like, a preferred method utilizes ELISA-type methodology wherein the antibody is immobilized on a solid support and a target protein or peptide is exposed to the immobilized antibody. Either the probe, or the target, or both, can be labeled. A variety of labeling strategies, labels, and the like, are known in the art.

In particularly preferred embodiments of the invention, expression patterns or profiles of a plurality of genes differentially expressed in osteoarthritis are observed utilizing arrays of probes for detecting target nucleic acids or proteins. In one embodiment, arrays of oligonucleotide or polynucleotide probes may be utilized, whereas another embodiment may utilize arrays of antibodies or other proteins that bind specifically to the differentially expressed gene products. Such arrays are commercially available (e.g., through Affymetrix, Inc., Applied Biosystems, Inc., Agilent, Inc.), or they may be custom made according to known methods, such as, for example, in-situ synthesis on a solid support or attachment of pre-synthesized probes to a solid support via microprinting techniques. In preferred embodiments, arrays of nucleic acid or protein-binding probes are custom made to specifically detect transcripts or proteins produced by two or more of the 1558 differentially expressed genes or gene fragments described herein. In one embodiment of the invention, arrays of nucleic acid or protein-binding probes are custom made to specifically detect transcripts or proteins produced by two or more of the genes or gene fragments identified in Table 2. In a preferred embodiment, arrays of nucleic acid or protein-binding probes are custom made to specifically detect transcripts or proteins produced by two or more of the 396 differentially expressed genes or gene fragments identified in Table 3. In a preferred embodiment, arrays of nucleic acid or protein-binding probes are custom made to specifically detect transcripts or proteins produced by two or more of the 217 differentially expressed genes or gene fragments identified in Table 4.

Preferably, a collection of two or more nucleic acid or polypeptide probes for detecting expression of gene products differentially expressed in OA is immobilized on a support in discrete locations, more preferably a collection of about 10 or more probes, more preferably a collection of about 50 or more probes, more preferably a collection of about 200 or more probes, more preferably a collection of about 400 or more probes, more preferably a collection of about 1000 or more probes.

Since chondrocytes represent the cellular component of cartilage, a tissue affected by OA, the construction of a chondrocyte array may represent a powerful tool to study the gene expression profile of osteoarthritic chondrocytes. The use of differential display for transcript selection was used by the present inventors to enrich the clones represented on an array for transcripts associated with OA.

In one aspect of the invention, methods are provided for assaying OA-associated nucleic acids in a sample. Preferably, a combination comprising one or more polynucleotide molecules selected from SEQ ID NOs:1-1558, more preferably selected from SEQ ID NOs:1-396, more preferably selected from SEQ ID NOs:1-217, are used to prepare probes that are hybridized with nucleic acids of a test sample, forming hybridization complexes that are detected and compared with those of a standard, such that differences between the sample and standard hybridization complexes are indicative of differential expression of nucleic acids in the sample. In a preferred embodiment, nucleic acid probes are made to specifically detect transcripts or fragments thereof produced by one or more of the genes or gene fragments identified in Table 2. In certain preferred embodiments, the nucleic acids of the sample may be amplified prior to hybridization.

In another aspect of the invention, methods are provided for assaying OA-associated polypeptides in a sample. Preferably, polynucleotide sequences selected from SEQ ID NOs:1-1558, more preferably selected from SEQ ID NOs:1-396, more preferably selected from SEQ ID NOs:1-217 are used to prepare protein-binding probes that specifically bind to translation products of those polypeptides or fragments thereof. These probes are reacted with a test sample, forming binding complexes that are detected and compared with those of a standard, such that differences between the sample and standard binding complexes are indicative of differential expression of polypeptides in the sample. In a preferred embodiment, protein-binding probes are made to specifically detect polypeptides or fragments thereof produced by one or more of the genes or gene fragments identified in Table 2.

According to certain preferred embodiments of the invention, the assays described herein for the detection of OA-associated transcription and translation products may be used in methods useful for determining a diagnosis and/or prognosis for osteoarthritis in a patient. According to an embodiment of the invention, a typical diagnostic test will comprise obtaining a sample of cells or tissue from a patient in which OA-associated gene expression is expected to occur. Such cells or tissues include, but are not limited to, cartilage tissue and chondrocytes. The sample is then analyzed for either 1) increased or decreased expression of one or more selected genes, via detection of mRNA or protein, or 2) a particular gene expression profile, for example, via gene or protein array technology, as described herein. Such a diagnostic procedure should lead to a determination of whether indications of osteoarthritis are present in the patient.

In another embodiment of the invention, the diagnostic procedures described herein may also be extended to provide prognostic information regarding a patient's recovery from OA, or to monitor a patient's progress in response to a therapeutic regimen. In these situations, the diagnostic assay is performed at intervals during the patient's recovery or course of treatment, and a change in expression of a target gene, or a particular change in the pattern of gene expression, is indicative of the patient's level of recovery or improvement.

In one aspect of the invention, assays are provided for identifying substances effective in treatment modalities for osteoarthritis. In one embodiment of the invention, a method is provided for measuring the effect of a test substance on the expression profile of genes differentially expressed in osteoarthritis, comprising the steps of: a) obtaining a standard expression profile from a first sample by measuring transcription or translation products of two or more genes corresponding to two or more genes or gene fragments identified in Tables 1 and/or 2 in the absence of the test substance; b) obtaining a test expression profile from a second sample by measuring the transcription or translation products of two or genes or gene fragments identified in Tables 1 and/or 2 expressed in the presence of the test substance; c) comparing the standard expression profile the test expression profile, wherein a change in the test expression profile compared to the standard expression profile is indicative of an effect of the test substance on the expression profile of genes differentially expressed in osteoarthritis compared to a non-osteoarthritic condition. Preferably, the two or more genes or gene fragments correspond to two or more of the genes or gene fragments identified in Table 3 (SEQ ID NOs:1-396). More preferably, the two or more genes or gene fragments correspond to two or more of the genes or gene fragments identified in Table 4 (SEQ ID NOs:1-217). In certain preferred embodiments, the samples are obtained from cultured cells. In this case, the standard expression profile is obtained from cells that have not been contacted with the test substance, while the test expression profile is obtained from cells that have been contacted with a test substance.

Test compounds may include proteins, polypeptides, nucleic acids, small molecule pharmaceuticals, vitamins, minerals, fatty acids, polysaccharides, extracts, nutriceuticals, and the like. In a preferred embodiment, the test compounds are nutrients that may be added to food or other dietary substances, or that may be taken as a dietary supplement. As exemplified herein, such nutrients include, but are not limited to, fatty acids such as omega-3 fatty acids (e.g., eicosapentaenoic acid) and omega-6 fatty acids (e.g., arachidonic acid), glucosamine, chondroitin sulfate and vitamin D derivatives such as 1α,25-dihydroxyvitamin D3 and 24R,25-dihydroxyvitamin D3.

One type of assay according to an embodiment of the invention involves measuring the activity of the protein encoded by one of the aforementioned OA-associated genes in the presence or absence of a candidate substance. Such activity assays are well known in the art. If a cell-free activity assay is available for the selected protein, such an assay is simply conducted on the purified protein in the presence or absence of the test substance. Candidate substances are selected based on their ability to positively or negatively regulate activity of the purified protein. It should be noted that assays of this type may be performed, for example, in a recombinant cellular system, as described below. They can also be performed, for example, in a cell-free system in some instances.

For such in vitro activity assays, it is desirable to have a source of the purified protein of interest. One or more of the protein products of the genes mentioned above may be commercially available, or purifiable in significant quantities from an appropriate biological source, e.g., cultured cells. Alternatively, the proteins may be recombinantly produced from an isolated gene or cDNA by expression in a suitable procaryotic or eucaryotic expression system, and thereafter purified, as is also well known in the art.

Another embodiment of the invention comprises in vitro cellular assays for expression of OA-associated genes or activity of their encoded proteins. For these embodiments, a nucleic acid construct comprising an OA-associated gene according to an aspect of the invention is introduced into host cells. In a preferred embodiment, mammalian cell lines are utilized. Host cells contemplated for use include, but are not limited, to NIH3T3, CHO, HELA, and COS, as well as non-mammalian cells such as yeast, bacteria and insect cells. The coding sequences are operably linked to appropriate regulatory expression elements suitable for the particular host cell to be utilized. Methods for introducing nucleic acids into host cells are well known in the art. Such methods include, but are not limited to, transfection, transformation, calcium phosphate precipitation, electroporation and lipofection. The recombinant cells may be used to identify compounds which modulate expression of the OA-associated genes or activity of their encoded proteins.

For gene expression assays, it is preferred to prepare an artificial construct comprising the promoter of a selected OA-associated gene, operably linked to a reporter gene. The reporter construct may be introduced a cultured cell, including, without limitation, the standard host cell lines described above, or other suitable cells, for example, cartilage-related cells such as chondrocytes. The assay is performed by monitoring expression of the reporter gene in the presence or absence of a test compound. Candidate substances are selected based on their ability to positively or negatively affect expression of the gene.

In another embodiment of the invention, OA-associated genes and gene fragments described herein may be used to manipulate the genome of non-human animal subjects. Methods of manipulating the genomes of a variety of animals are known to those of skill in the art. Such methods may include, without limitation, the production of transgenic and gene-knockout animals. In a preferred embodiment of the invention, a gene or gene fragment identified in Table 2 is used to prepare a construct that is used to disrupt or "knock out" the corresponding endogenous gene in an animal, thus producing an animal having a null mutation for that gene locus. In some embodiments, the animals exhibit a reduction or complete elimination of the expression of one or more genes having a nucleic acid sequence selected from SEQ ID NOs:1-1558. In some embodiments, the animals exhibit a reduction or complete elimination of the expression of one or more genes having a nucleic acid sequence selected from SEQ ID NO:1-396. In some embodiments, the animals exhibit a reduction or complete elimination of the expression of one or more genes having a nucleic acid sequence selected from SEQ ID NO:1-217. In other embodiments, the animals exhibit a reduction or complete elimination of the expression of one or more genes shown in Table 6. The transgenic animals are preferably mammals. In some embodiments, the transgenic animals are rodents (e.g., mice and rats). In other embodiments, the animals are, for example, goats, cats, dogs, cows, pigs, sheep, horses, non-human primates, rabbits, and guinea pigs. In some embodiments, small interfering RNAs are used to functionally disrupt the genes. Briefly, gene expression is inhibited by a short interfering RNA (siRNA) through RNA interference (RNAi) or post-transcriptional gene silencing (PTGS) (see, for example, Ketting et al. (2001)*Genes Develop.* 15:2654-2659). siRNA molecules can target homologous mRNA molecules for destruction by cleaving the mRNA molecule within the region spanned by the siRNA molecule. Accordingly, siRNAs capable of targeting and cleaving mRNA of the gene products shown in Table 6 may be used to decrease or eliminate expression of one or more of these genes. In other embodiments, siRNAs capable of targeting and cleaving mRNA of one or more of the genes shown in Table 1 (SEQ ID NOS:1-1558) may be used to decrease or eliminate expression of one or more of these genes.

In another embodiment of the invention, OA-associated genes and gene fragments described herein are used to design molecules that may be used to interfere with the expression of one or more OA-associated genes; such molecules may include, without limitation, RNA interference probes and antisense molecules.

Another aspect of the invention features compositions of matter to facilitate practice of the assays described above. These compositions may comprise collections of two or more probes or primers for use in detecting differentially expressed OA-related genes, gene fragments and encoded proteins according to certain aspects of the invention. In one embodiment, the compositions may comprise collections of two or more oligonucleotides or polynucleotides that specifically hybridize with nucleic acid molecules selected from SEQ ID NOS:1-1558. Preferably, the compositions may comprise collections of two or more oligonucleotides or polynucleotides that specifically hybridize with nucleic acid molecules selected from SEQ ID NOS:1-396. More preferably, the compositions may comprise collections of two or more oligonucleotides or polynucleotides that specifically hybridize with nucleic acid molecules selected from SEQ ID NOS:1-217. Preferably, the composition may comprise collections of two or more oligonucleotides or polynucleotides that specifically hybridize with genes and/or gene fragments selected from the genes and gene fragments identified in Table 2. The collection may comprise a primer pair for amplifying the sequence. In certain preferred embodiments, amplification may be performed using Polymerase Chain Reaction (PCR), more preferably quantitative PCR (qPCR). In a preferred embodiment, the collection comprises a larger plurality of probes, e.g., about 10, 50, 200, 400, 1000 or more probes, each of which hybridizes specifically with part or all of one of the sequences of SEQ ID NOS:1-1558. In a preferred embodiment, nucleic acid probes are immobilized on a solid support. In a particularly preferred embodiment, they are immobilized in an array format, most preferably in a miniature or micro-array. Such micro-arrays are known in the art, and are sometimes referred to as "DNA chips," "microchips," "biological chips" and other similar terms, and may contain the entire array of genes or gene fragments altered by OA, in addition to those represented in Tables 1 and 2.

In another embodiment, these compositions comprise two or more protein binding substances capable of specifically binding proteins or protein fragments encoded by the genes and gene fragments identified in Tables 1 and 2. In a preferred embodiment the binding substances are antibodies and the collection comprises two or more antibodies for detecting two or more proteins or peptides encoded by SEQ ID NOS: 1-1558, respectively. Preferably, these compositions comprise two or more protein binding substances capable of specifically binding proteins or protein fragments encoded by the genes and gene fragments of SEQ ID NOS:1-396. More preferably, these compositions comprise two or more protein binding substances capable of specifically binding proteins or protein fragments encoded by the genes and gene fragments of SEQ ID NOS:1-217. Such binding substances may be any molecule to which the protein or peptide specifically binds, including DNA (for DNA binding proteins), antibodies, cell membrane receptors, peptides, cofactors, lectins, sugars, polysaccharides, cells, cell membranes, organelles and organellar membranes. In a preferred embodiment, the collection comprises a larger plurality of antibodies, e.g., about 10, 50, 200, 400, 1000 or more, each of which binds immunospecifically with part or all of a protein or peptide encoded by genes or gene fragments identified in Tables 1 and/or 2. In a preferred embodiment, the antibodies are immobilized on a solid support. In a particularly preferred embodiment, they are immobilized in an array format, most preferably in a miniature or micro-array, as described above for oligonucleotide probes, and may contain the entire array of proteins altered by OA, in addition to genes or gene fragments identified in Tables 1 and 2.

Another embodiment of the present invention relates to substances or compounds identified in any of the methods described herein as having an effect on the expression profile of genes differentially expressed in OA. Preferably, such substances will be effective in the treatment and/or prevention of OA.

Still another aspect of the invention features test kits for use in one or more of the assays described herein. One type of kit comprises one or more pairs of primers for amplifying nucleic acids corresponding to the OA-associated genes and gene fragments described herein. The kit may further comprise samples of total mRNA derived from tissue of various physiological states, for use as controls. The kit may also comprise buffers, nucleotide bases, and other compositions to be used in hybridization and/or amplification reactions. Each solution or composition may be contained in a vial or bottle and all vials held in close confinement in a box for commercial sale.

Another type of kit comprises one or more nucleic acid or protein-binding probes, wherein the nucleic acid probe hybridizes specifically with a OA-associated gene or gene fragment according to certain aspects of the invention, or the protein-binding probe specifically binds to a protein encoded by the OA-associated gene or gene fragment. Preferably, the protein-binding probe is an antibody that is immunologically specific for the protein encoded by the OA-associated gene or gene fragment. In preferred embodiments, the nucleic acid or protein-binding probes are immobilized on a solid support. In a particularly preferred embodiment, the kit comprises immobilized arrays of nucleic acid or protein-binding probes, the arrays comprising probes specific for a plurality of the OA-associated genes or gene fragments described herein, or proteins encoded thereby. These kits also may contain appropriate control samples of mRNA or protein from tissues of known physiological state, to be used as controls in the assays. They may further comprise buffers and reagents for performing the assays. Each solution, reagent or composition in the kit may be contained in a vial or bottle and all vials held in close confinement in a box for commercial sale. Preferably, kits may further comprise instructions for performing an assay of gene expression.

In another aspect, the invention provides a method for altering biological profile of cells through inducing a change in the gene expression profile of the cells with respect to genes involved in OA. The method involves administering to cells an effective amount of a compound that alters the expression of one or more genes having a nucleic acid sequence selected from SEQ ID NOs:1-1558. In some embodiments, the compound affects the expression of one or more genes having a nucleic acid sequence selected from SEQ ID NOs:1-396. In some embodiments, the compound affects the expression of one or more genes having a nucleic acid sequence selected from SEQ ID NOs:1-217. In other embodiments, the compound affects the expression of one or more genes having the gene products shown in Table 6. The invention also provides a method of affecting the expression of genes involved in OA comprising exposing cells to an effective amount of a compound that modulates expression of one or more genes having a sequence selected from SEQ ID NOs:1-1558. In some embodiments, the compound affects the expression of one or more genes having a nucleic acid sequence selected from SEQ ID NOs:1-396. In some embodiments, the compound affects the expression of one or more genes having a nucleic acid sequence selected from SEQ ID NOs:1-217. In other embodiments, the compound affects the expression of one or more genes having the gene products shown in Table 6.

In some embodiments the cells are cells associated with symptoms of osteoarthritis. In some embodiments the cells are chondrocytes. In some embodiments the compounds are administered to cells in vitro. In other embodiments the compounds are administered to cells in vivo. The compounds may be administered to subjects via any route of administration. Preferably, the subjects are vertebrates. More preferably, the subjects are mammals including dogs, cats and humans.

The change in gene expression is preferably at least a 1.01 fold difference. More preferably, it is at least a 1.05, 1.10, 1.25, 1.50, 1.75, 2.0, 2.25, 2.50, 2.75, 3.0, 3.25, 3.50, 3.75, 4.0 fold difference or more.

Chondroitin sulfate was shown to have an effect on a wide variety of OA-associated genes as shown in detail in Tables 7-12. Glucosamine was also found to have an effect on a variety of OA-associated genes as shown in detail in Tables 13-18. 1α,25-dihydroxyvitamin D3 and 24R,25-dihydroxyvitamin D3 also affected the expression of OA-related genes as shown in Tables 19-20. Eicosapentaenoic acid (EPA) and arachidonic acid (AA) were also shown to affect OA-related genes as shown in Tables 21-23.

The following examples are provided to describe the invention in greater detail. They are intended to illustrate, not to limit, the invention.

EXAMPLE 1

Extraction of RNA from Chondrocytes

Normal and osteoarthritic canine cartilage chondrocytes ($N_2$-flash frozen) were obtained and stored at −80° C. Osteoarthritic chondrocytes originated from canines clinically diagnosed with osteoarthritis undergoing total hip replacement. 300 to 500 mg were ground in $N_2$ (mortar and pestle) and transferred to a clean, pre-chilled, 50 ml tube. Trizol (2 ml/100 mg) was added and the mixture was homogenized using a Polytron for 2×30 seconds, and 1 minute (high speed). The homogenate was then centrifuged at 10,000×g for 10 minutes at 4° C. The supernatant was removed and 0.2 volumes chloroform added to the supernatant, vortexed, and centrifuged at 10,000×g for 15 minutes at 4° C. The upper aqueous phase was removed and 5 volumes of 4 M Guanidine thiocyanate, 25 mM sodium citrate, 0.5% sarkosyl, 0.1 M beta-mercaptoethanol and 0.475 volumes of 100% ethanol were added to the upper aqueous phase. The solution was then applied to Qiagen RNAqueous mini-columns (cat #74104), using a vacuum manifold (according to the manufacture's directions) for further purification of the RNA. The purified RNA was then ethanol precipitated to concentrate, resuspended in DEPC water and DNAse I treated to remove residual DNA. The DNA-free™ DNAse Treatment kit from Ambion (cat #1906) was used for DNAse I treatment according to the manufacture's directions.

RNA was quantitated in a Beckman DU 640B spectrophotometer at 260 nm (Beckman Coulter, Inc., 4300 N. Harbor Boulevard, P.O. Box 3100, Fullerton, Calif. 92834-3100). Absorbance of 1 at 260 nm is equivalent to 40 µg RNA/ml. Typical yields were 0.65 to 0.8 µg/µl. Quality of RNA was determined by the absorbance at 260 nm/280 nm with a typical ratio of 1.7-2.0. Quality was also assessed by electrophoresis in a 1% agarose gel/formaldehyde/Tris-borate-EDTA (TBE), pH 7.8 buffer (90 mM Tris, 90 mM boric acid, 2 mM EDTA). Approximately 1 to 3.5 µg RNA was loaded (2 to 5 µl) after being mixed with 15 µl gel loading solution (10 mM Tris pH 7.5, 1 mM EDTA, 0.02% bromophenol blue, 10% glycerol). The gel was run at 50 Volts for 3-4 hours, stained with SYBR Green I (Molecular Probes, Inc., PO Box 22010, Eugene, Oreg. 97402-0469, 4849 Pitchford Ave., Eugene, Oreg. 97402-9165) at a dilution of 1:10,000 for 30 minutes in the dark and scanned using a Hitachi FMBIO II Fluorescent scanner at 505 nm (Hitachi Genetic Systems, 1201 Harbor Bay Parkway Step. 150, Alameda, Calif. 94502).

EXAMPLE 2

Differential Display

Fluorescent differential display was performed using one of three anchored primers in combination with one of 80 arbitrary primers (GenHunter). In all, 240 PCR reactions were carried out. Reactions were separated using PAGE and visualized using a fluorescent scanner (FMBIOII, Hitachi). Bands representing differentially expressed genes were excised, reamplified and run on an agarose gel to verify size. These were subsequently subcloned (PCR-TRAP, GenHunter) and sequenced.

Differential display was performed using GenHunter's RNAimage® kit or RNAspectra™ green fluorescent mRNA differential display systems (GenHunter Corporation, 624 Grassmere Park Drive, Suite 17, Nashville, Tenn. 37211). Approximately 200 ng of RNA was reverse transcribed in the following reaction (final concentration): RT buffer (25 mM Tris-Cl, pH 8.3, 37.6 mM KCl, 1.5 mM $MgCl_2$, 5 mM DTT), 625 µM ea. dNTP, 50 pmol $H-T_{11}G$ primer (GenHunter) (5'AAGCTTTTTTTTTTG 3') (SEQ ID NO:1559), or $H-T_{11}C$ primer (GenHunter) (5'AAGCTTTTTTTTTTC 3') (SEQ ID NO:1560), or $H-T_{11}A$ primer (GenHunter) (5'AAGCTTTTTTTTTTA 3') (SEQ ID NO:1561), in a total volume of 19 µl. 1 µl (100 units/µl) of MMLV reverse transcriptase was added ten minutes into the 37° C. step in a thermocycler (GeneAmp PCR System 9700, PE Applied Biosystems, 850 Lincoln Center Dr., Foster Calif. 94404) and the following reaction performed: 65° C. 5 minutes, 37° C. 60 minutes, 75° C. 5 minutes followed by a hold at 4° C. Two µl of the reverse transcription reaction was used in the following polymerase chain reaction: PCR buffer (10 mM Tris-Cl, pH 8.4, 50 mM KCl, 1.5 mM $MgCl_2$, 0.001% gelatin), 50 µM each dNTP, 5 pmol Fluorescein-labeled $H-T_{11}G$ primer (GenHunter) (Fluorescein-labeled primer, 5' AAGCTTTTTTTTTTG 3') (SEQ ID NO:1562), or Fluorescein-labeled $H-T_{11}C$ primer (GenHunter) (Fluorescein-labeled primer, 5' AAGCTTTTTTTTTTC 3') (SEQ ID NO:1563) or Fluorescein-labeled $H-T_{11}A$ primer (GenHunter) (Fluorescein-labeled primer, 5' AAGCTTTTTTTTTTA 3') (SEQ ID NO:1564) one of the H-AP primers provided in the kit at 200 pM, 1 unit of Amplitaq DNA polymerase (PE Applied Biosystems, 850 Lincoln Center Dr., Foster Calif. 94404) in a total of 20 µl.

The following thermocycler reaction was used: 40 cycles of 94° C. 15 seconds, 40° C. 2 minutes, 72° C. 30 seconds, followed by 72° C. 5 minutes and a 4° C. hold.

5 µl of each PCR sample was mixed with 5 µl blue dextran loading buffer and 10 µl deionized formamide and electrophoresed on a 6% polyacrylamide gel at 55 watts for 3 hours in TBE buffer. The gel was scanned using a Hitachi FMBIO II at 505 nm. cDNA bands differentially expressed were excised with a razor, placed in a 1.5 ml tube, soaked in 100 µl sterile water for 10 minutes and then boiled for 15 minutes. Tubes were centrifuged for 2 minutes at 10,000×g and the supernatant transferred to a new tube. 10 µl 3M sodium acetate, 5 µl glycogen (10 mg/ml) and 450 µl 100% ethanol was added to the supernatant and the tubes were placed at −80° C. overnight. Samples were centrifuged at 10,000×g for 10 minutes at 4° C. and the supernatant was removed. cDNA pellets were washed with cold (−20° C.) 85% ethanol, spun as above for 1 minute and the supernatant was removed. cDNA pellets were resuspended in 10 µl sterile water.

Four µl samples of the cDNA extracts were amplified the same as in the above PCR reaction with the following exceptions: 40 µl total reaction volume; 20 µM ea. dNTP; 200 pM unlabeled primer H-$T_{11}$G, H-$T_{11}$C, or H-$T_{11}$A (GenHunter) and 2 units of Amplitaq DNA polymerase (PE Applied Biosystems). PCR conditions were the same as above. 15 µl of the amplified cDNA extracts were mixed with 3 µl 6× loading dye (0.25% bromophenol blue, 0.25% xylene cyanol FF, 30% glycerol) and electrophoresed in a 1.5% agarose gel. The gel was run at 100 volts for 2 to 3 hours in TBE buffer, stained/visualized the same as above. Bands were excised with a razor and cDNA extracted according to Qiagen's QIAEX® II Gel Extraction Kit (Qiagen, Inc., 28159 Avenue Stanford, Valencia, Calif. 91355). Three hundred µl QX1 buffer and 10 µl QIAEX® II suspension was added to each gel slice in a 1.5 ml tube and incubated at 50° C. for 10 minutes. Tubes were vortexed every 2 minutes during incubation. Tubes were centrifuged 10,000×g for 30 seconds and the supernatant was discarded. Pellets were washed once with 500 µl Buffer QX1 and twice with buffer PE (vortexing and centrifuging as above for each wash). Pellet was air dried for 10 minutes and 20 µl sterile water was added. Tubes were incubated for 5 minutes at room temperature and cDNA was eluted by centrifugation as above for 30 seconds. Supernatant was then transferred to a new 1.5 ml tube and stored at −20° C.

Amplified gel purified cDNA was subcloned according to GenHunter's PCR-TRAP® Cloning System Kit (GenHunter Corporation, 624 Grassmere Park Drive, Suite 17, Nashville, Tenn. 37211). 5 µl amplified gel purified cDNA was added to 300 ng PCR-TRAP® vector, ligase buffer (50 mM Tris-Cl, pH 7.8, 10 mM $MgCl_2$, 10 mM DTT, 10 mM ATP, 5 µg BSA) and 200 units T4 DNA ligase, mixed, and incubated overnight at 16° C. GH competent cells (*E. coli* del(lac-pro) ara thi (φ80dlacZdelM15)) were transformed with ligation reaction by mixing 10 µl ligation reaction to 100 µl GH competent cells on ice in 1.5 ml tubes. Tubes were incubated on ice for 45 minutes, heat shocked at 42° C. for 2 minutes and then incubated on ice for 2 minutes. 400 µl LB broth (Luria-Bertani, Difco) was added to each tube and the tubes were incubated at 37° C. for 1 hour with shaking (250 rpm). 200 µl of these transformations were plated onto LB-agar-tet plates (LB-agar, Difco, tetracycline 20 µg/ml) and incubated overnight at 37° C.

Colonies were checked for insert using GenHunter's colony lysate PCR protocol. Colonies were picked with a clean pipette tip and placed in 50 µl colony lysate buffer (GenHunter, TE with 0.1% Tween 20) in a microfuge tube. Tubes were boiled for 10 minutes, centrifuged at 10,000×g for 2 minutes and the corresponding lysate (supernatant) was transferred to a new microfuge tube. 2.0 µl of lysate was added to PCR buffer, 20 µM ea. dNTP, 200 (pmol ea. of Lgh (5'CGACAACACCGATAATC) (SEQ ID NO:1565) and Rgh (5' GACGCGAACGAAGCAAC) (SEQ ID NO:1566) primers and 1 unit of Amplitaq DNA polymerase (PE Applied Biosystems) in a total volume of 20 µl. The following thermocycler reaction was used: 30 cycles of 94° C. for 30 seconds, 52° C. for 40 seconds and 72° C. for 1 minute followed by 72° C. for 5 minutes and a 4° C. hold. PCR products were analyzed in a 1.5% agarose gel the same as above.

3-5 ml LB broth was inoculated with appropriate colonies and incubated overnight at 37° C. at 250 rpm. Plasmids were isolated according to Qiagen's QIAprep Plasmid protocol. Bacteria were pelleted (10,000×g, 30 seconds) using 2×1.5 ml inoculated broth and the supernatant was removed. Pelleted bacteria were resuspended in 250 µl buffer P1, 250 µl buffer P2 was then added and tubes were mixed by gentle inversion. 350 µl buffer N3 was added, tubes were mixed by gentle inversion and then centrifuged for 10 minutes. Supernatants were added to a QIAprep column and centrifuged for 30 seconds. Flow-throughs were discarded, 0.5 ml of buffer PB was added to column and tubes were centrifuged for 30 seconds. Columns were washed with 0.75 ml buffer PE and centrifuged for 30 seconds. Flow-throughs were discarded and tubes were spun an additional minute. DNA was eluted from the column by adding 50 µl sterile water to the column. The column was incubated at room temperature for 1 minute and then centrifuged for 1 minute. Resulting supernatant containing plasmid DNA was quantitated as above (absorbance of 1 at 260 nm equals 50 µg/ml) with a typical yield of 350 µg/ml and a 260 nm/280 nm ratio of 1.8.

Sequencing reactions used 200 to 500 ng plasmid DNA in the ABI Prism BigDye Terminator Cycle Sequencing Ready Reaction Kit (PE Applied Biosystems, 850 Lincoln Center Dr., Foster Calif. 94404). 0.8 µl of primer (0.16 µm final concentration of either Lgh or Rgh, GenHunter) was added to plasmid DNA along with 4.0 µl Terminator Reaction Mix (containing AmpliTaq DNA Polymerase, FS, deoxynucleoside triphosphates, $MgCl_2$, Tris-HCL buffer, pH 9.0, A-Dye Terminator labeled with dichloro(R6G), C-Dye Terminator labeled with dichloro(ROX), G-Dye Terminator labeled with dichloro(R110) and T-Dye Terminator labeled with dichloro (TAMRA)) and brought to a final volume of 10 µl with sterile water. The following thermocycler reaction was used: 25 cycles of 96° C. for 10 seconds, 50° C. for 5 seconds, 60° C. for 4 minutes followed by a 4° C. hold.

Unincorporated dye-terminators were removed from the sequencing reactions according to Qiagen's DyeEx spin protocol. Prepared DyeEx spin columns were placed in 2.0 ml microfuge tubes and centrifuged at 750×g for 3 minutes. Columns were placed in new tubes, sequencing reactions were added to columns and centrifuged, as above, for 3 minutes. The eluate was placed at 74° C. until dry.

5 µl of formamide/blue dextran (5:1 ratio) was added to each dried sequencing pellets. 1.5 µl to 2.0 µl was then added to a 5% polyacrylamide gel (in TBE buffer) on a Perkin Elmer ABI Prism 377 automated DNA sequencer.

Each isolated plasmid clone was sequenced 2-6 times (2-6 different sequencing reactions, 1-3 times for each primer, Lgh or Rgh). Sequence files from the ABI 377 sequencer were transferred to Genetic Computer Group's Wisconsin Package and a corresponding consensus sequence was determined.

Figure 1B:
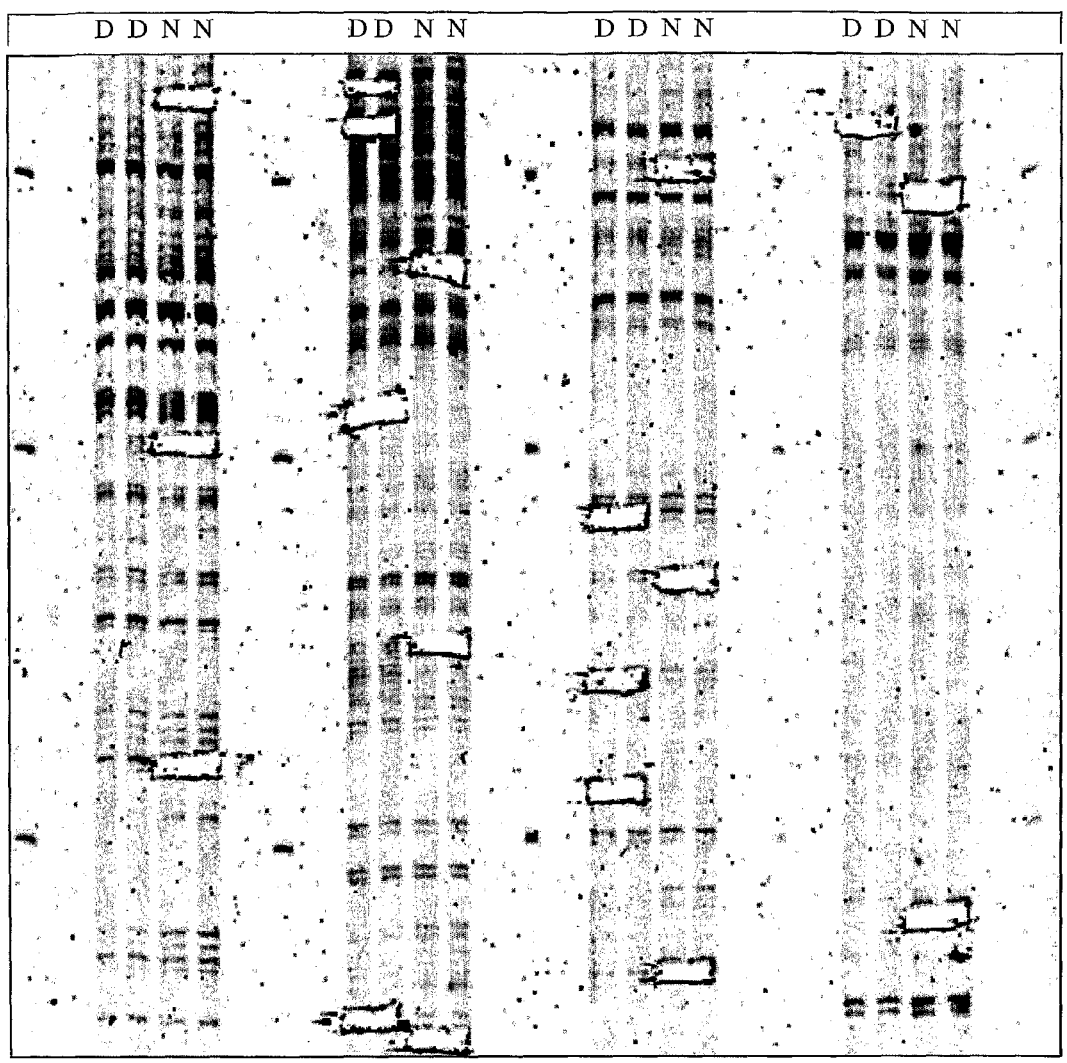
Figure 2A:
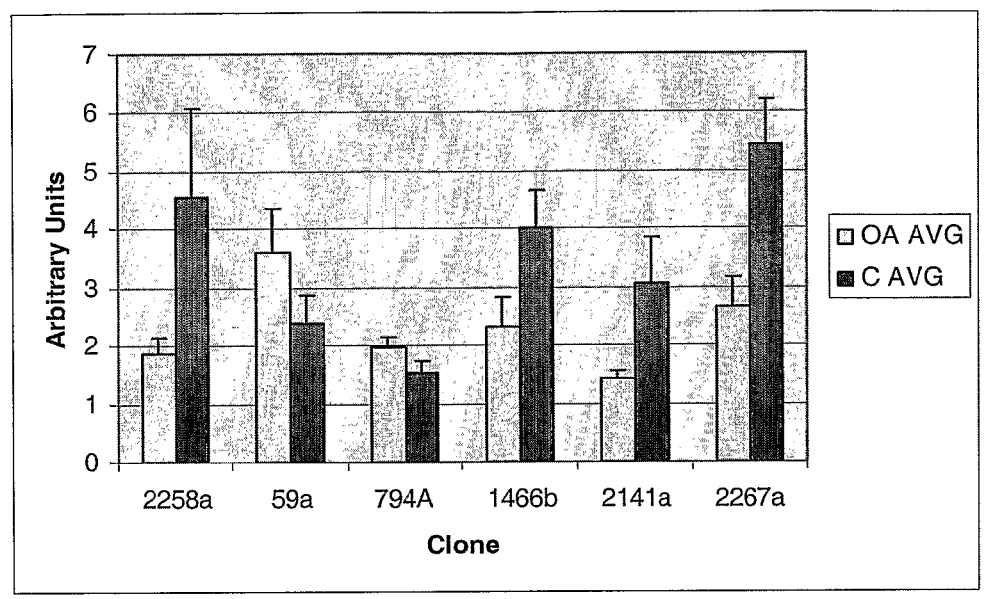
FIG. 2 shows quantitative PCR analysis (qPCR) for selected OA-associated transcripts in canine cartilage. RNA expression is shown in arbitrary units. (OA AVG=average expression for osteoarthritic cartilage; C AVG=average expression in normal control).
Figure 2B:
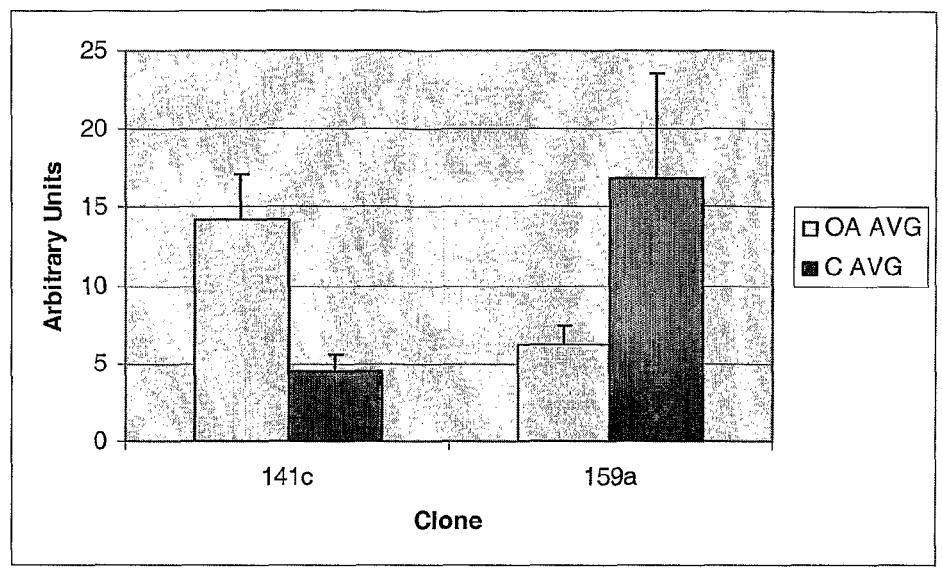
Figure 2C:
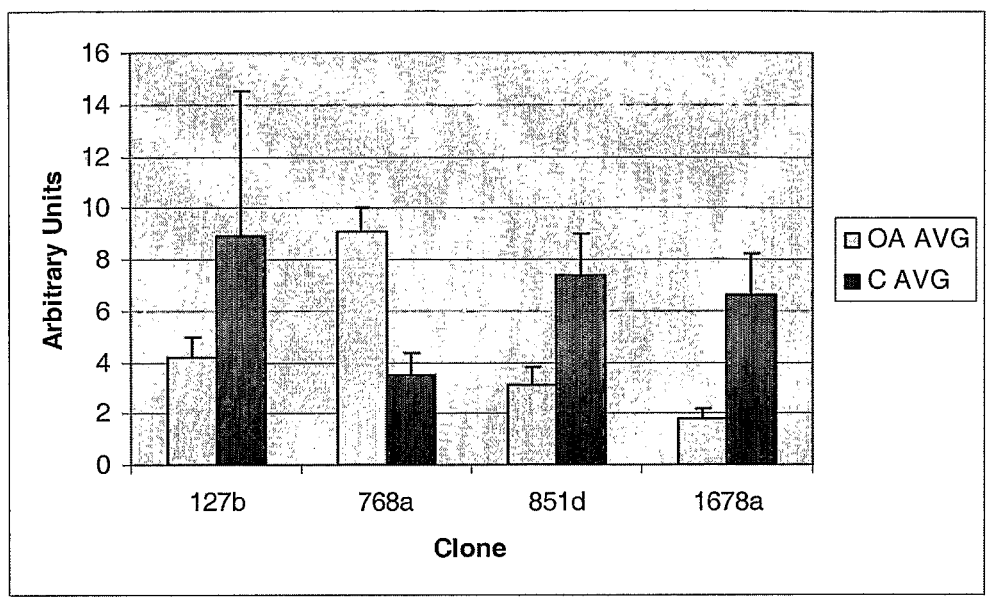
Figure 2D:
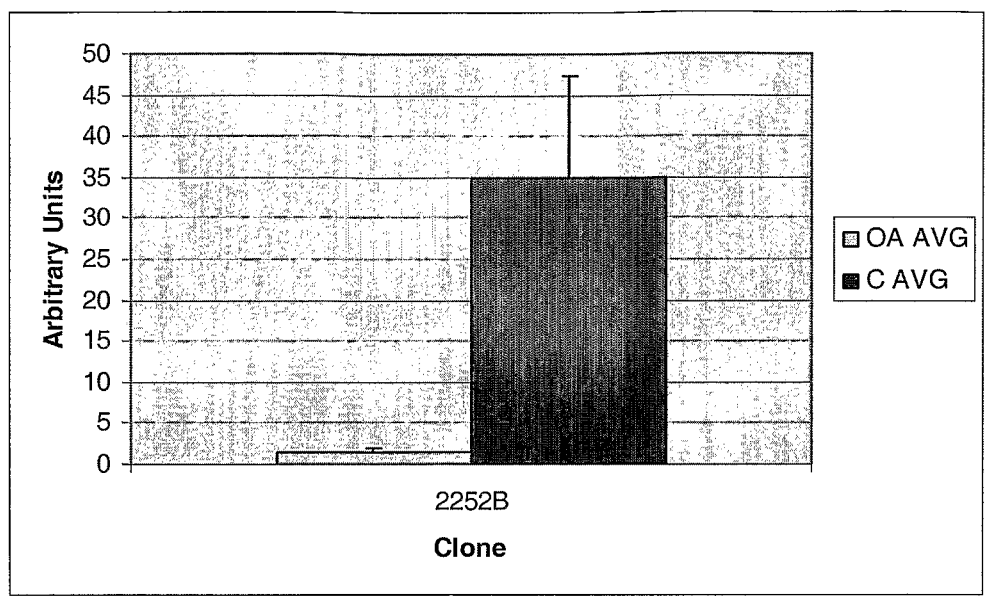
Figure 2E:
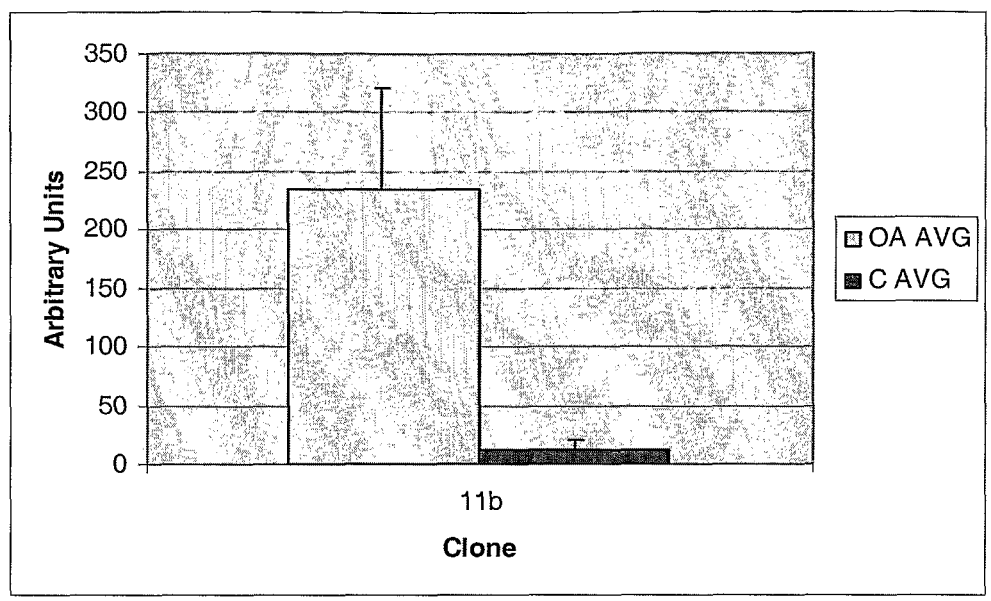

Approximately 1750 clones were isolated using differential display. All genes that appeared to be differentially expressed were selected. A representational polyacrylamide gel image is shown in FIG. 1. Panel A represents the gel prior to band excision and panel B represents the same gel after band excision. Sizes of clones ranged from 90 b.p. to 1150 b.p., with an average size of 300 b.p. After filtering the sequences for redundant sequences, dimers, *E. coli* fragments, fragments <100 b.p. etc., 1558 remained. Sequences obtained (SEQ ID NOs:1-1558) are shown in Table 1, which is appended herewith and which forms part of the present specification.

The sequences obtained were BLASTed against the human, mouse and dog public domain genomes to get a first hit. To be considered a hit at this stage, the match had to cover more than 50% of the sequence and an Expect value (E value) of less than 0.002. The first hits were used to extend the sequence using the respective genome. The sequences were either extended 2 kb to the 5' or 3' side of the hit. The extended sequences were then used to BLAST against public domain protein databases (Ensembl, swissprot/trembl). The respective hits (those with an Expect value of less than 0.002, in this case) were consolidated and used for the annotations. In some cases, this strategy did not give hits, and in these situations the original sequences were BLASTed directly against swissprot/trembl or Ensembl proteins. In this case, hits were considered when the Expect value was less than 0.002.

Results of BLAST analysis (as of Jan. 28, 2004) of sequences isolated by differential display are shown in Table 2, which is appended herewith and which forms part of the present specification. The sequences are listed in the leftmost column by the gene ID designations (clone numbers) employed by the inventors herein. Many sequences matched with a Description of a previously-identified gene; the Description column also includes the source database and the corresponding database accession number. Table 2 includes additional information from a number of databases, including Ensemble Gene IDs, Ensemble Transcript IDs, Swissprot/Ensemble, OMIM (Online Mendelian Inheritance in Man), RefSeq, Pfam, InterPro and HUGO. Information is also shown regarding Chromosome Number (#) and Chromosome Location for many of the sequences. Additionally, the column labeled "Signal peptide" indicates the sequences for which a predicted signal peptide occurs in the amino acid sequence; the column labeled "TMHMM" (Transmembrane Hidden Markov Model) indicates sequences for which a predicted transmembrane region occurs in a protein sequence.

Table 6 lists clones demonstrating homology to previously-identified genes.

TABLE 6

| CaMax Gene ID | Description | SEQ ID NO |
|---|---|---|
| CaMax: 1006b | BUTYRATE RESPONSE FACTOR 2 (TIS11D PROTEIN) (EGF-RESPONSE FACTOR 2) (ERF-2). [Source: SWISSPROT; Acc: P47974] | 1360 |
| CaMax: 1007a | BUTYRATE RESPONSE FACTOR 2 (TIS11D PROTEIN) (EGF-RESPONSE FACTOR 2) (ERF-2). [Source: SWISSPROT; Acc: P47974] | 1361 |
| CaMax: 1009c | GRAVE'S DISEASE CARRIER PROTEIN (GDC) (GRAVE'S DISEASE AUTOANTIGEN) (GDA) (MITOCHONDRIAL SOLUTE CARRIER PROTEIN HOMOLOG). [Source: SWISSPROT; Acc: P16260] | 905 |
| CaMax: 1019a | ZINC FINGER PROTEIN 333. [Source: SWISSPROT; Acc: Q96JL9] | 934 |
| CaMax: 1020a | CALCITONIN GENE-RELATED PEPTIDE TYPE 1 RECEPTOR PRECURSOR (CGRP TYPE 1 RECEPTOR). [Source: SWISSPROT; Acc: Q16602] | 935 |
| CaMax: 1029a | TIGGER TRANSPOSABLE ELEMENT DERIVED 1; JERKY (MOUSE) HOMOLOG-LIKE. [Source: RefSeq; Acc: NM_145702] | 938 |
| CaMax: 1044c | POLY [ADP-RIBOSE] POLYMERASE-3 (EC 2.4.2.30) (PARP-3) (NAD(+) ADP-RIBOSYLTRANSFERASE-3) (POLY[ADP-RIBOSE] SYNTHETASE-3) (PADPRT-3) (HPARP-3) (IRT1). [Source: SWISSPROT; Acc: Q9Y6F1] | 1363 |
| CaMax: 104a | HETEROGENEOUS NUCLEAR RIBONUCLEOPROTEIN H (HNRNP H). [Source: SWISSPROT; Acc: P31943] | 439 |
| CaMax: 1061a | LEUKEMIA-ASSOCIATED PROTEIN WITH A CXXC DOMAIN. [Source: SPTREMBL; Acc: Q8NFU7] | 1160 |
| CaMax: 106a | FERRITIN HEAVY CHAIN (FERRITIN H SUBUNIT). [Source: SWISSPROT; Acc: P02794] | 440 |
| CaMax: 1105a | RAS-RELATED PROTEIN RAB-14. [Source: SWISSPROT; Acc: P35287] | 1320 |
| CaMax: 1108a | STAR-RELATED LIPID TRANSFER PROTEIN 13 (STARD13) (START DOMAIN-CONTAINING PROTEIN 13) (46H23.2). [Source: SWISSPROT; Acc: Q9Y3M8] | 1262 |
| CaMax: 1111b | SESTRIN 1 (P53-REGULATED PROTEIN PA26). [Source: SWISSPROT; Acc: Q9Y6P5] | 898 |
| CaMax: 1120a | GOLGI PHOSPHOPROTEIN 3; GOLGI PROTEIN; GOLGI PERIPHERAL MEMBRANE PROTEIN 1, 34 KDA; GOLGI-ASSOCIATED PROTEIN; COAT-PROTEIN. [Source: RefSeq; Acc: NM_022130] | 1366 |
| CaMax: 1134a | MYOCYTE-SPECIFIC ENHANCER FACTOR 2C. [Source: SWISSPROT; Acc: Q06413] | 1172 |
| CaMax: 1135a | FORKHEAD BOX PROTEIN P2 (CAG REPEAT PROTEIN 44) (TRINUCLEOTIDE REPEAT-CONTAINING GENE 10 PROTEIN). [Source: SWISSPROT; Acc: O15409] | 1173 |
| CaMax: 1145a | COLLAGEN ALPHA 1(XV) CHAIN PRECURSOR. [Source: SWISSPROT; Acc: P39059] | 1436 |
| CaMax: 104a | HETEROGENEOUS NUCLEAR RIBONUCLEOPROTEIN H (HNRNP H). [Source: SWISSPROT; Acc: P31943] | 439 |
| CaMax: 1169b | TROPOMYOSIN 1 ALPHA CHAIN (ALPHA-TROPOMYOSIN). [Source: SWISSPROT; Acc: P09493] | 1322 |
| CaMax: 1177c | DYNEIN HEAVY CHAIN, CYTOSOLIC (DYHC) (CYTOPLASMIC DYNEIN HEAVY CHAIN 1) (DHC1) (FRAGMENT). [Source: SWISSPROT; Acc: Q14204] | 943 |
| CaMax: 1184a | T-LYMPHOMA INVASION AND METASTASIS INDUCING PROTEIN 1 (TIAM1 PROTEIN). [Source: SWISSPROT; Acc: Q13009] | 885 |
| CaMax: 1213d | VAV-3 PROTEIN. [Source: SWISSPROT; Acc: Q9UKW4] | 1324 |
| CaMax: 1243a | WD-REPEAT PROTEIN 3. [Source: SWISSPROT; Acc: Q9UNX4] | 908 |

TABLE 6-continued

| CaMax Gene ID | Description | SEQ ID NO |
|---|---|---|
| CaMax: 1267a | PROPIONYL-COA CARBOXYLASE ALPHA CHAIN, MITOCHONDRIAL PRECURSOR (EC 6.4.1.3) (PCCASE ALPHA SUBUNIT) (PROPANOYL-COA: CARBON DIOXIDE LIGASE ALPHA SUBUNIT). [Source: SWISSPROT; Acc: P05165] | 874 |
| CaMax: 1267a | PROPIONYL-COA CARBOXYLASE ALPHA CHAIN, MITOCHONDRIAL PRECURSOR (EC 6.4.1.3) (PCCASE ALPHA SUBUNIT) (PROPANOYL-COA: CARBON DIOXIDE LIGASE ALPHA SUBUNIT). [Source: SWISSPROT; Acc: P05165] | 874 |
| CaMax: 1272a | PROTEIN TRANSPORT PROTEIN SEC24A (SEC24-RELATED PROTEIN A) (FRAGMENT). [Source: SWISSPROT; Acc: O95486] | 872 |
| CaMax: 1287c | IDN3 PROTEIN ISOFORM A. [Source: RefSeq; Acc: NM_133433] | 952 |
| CaMax: 1288a | IDN3 PROTEIN ISOFORM A. [Source: RefSeq; Acc: NM_133433] | 63 |
| CaMax: 128a | HEAT SHOCK PROTEIN HSP 90-BETA (HSP 84) (TUMOR SPECIFIC TRANSPLANTATION 84 KDA ANTIGEN) (TSTA). [Source: SWISSPROT; Acc: P11499] | 234 |
| CaMax: 1292c | ATP-DEPENDENT DNA HELICASE II, 80 KDA SUBUNIT (LUPUS KU AUTOANTIGEN PROTEIN P86) (KU86) (KU80) (86 KDA SUBUNIT OF KU ANTIGEN) (THYROID-LUPUS AUTOANTIGEN) (TLAA) (CTC BOX BINDING FACTOR 85 KDA SUBUNIT) (CTCBF) (CTC85) (NUCLEAR FACTOR IV) (DNA-REPAIR PROTEIN XRCC5). [Source: SWISSPROT; Acc: P13010] | 44 |
| CaMax: 1294b | BIFUNCTIONAL AMINOACYL-TRNA SYNTHETASE [INCLUDES: GLUTAMYL-TRNA SYNTHETASE (EC 6.1.1.17) (GLUTAMATE--TRNA LIGASE); PROLYL-TRNA SYNTHETASE (EC 6.1.1.15) (PROLINE--TRNA LIGASE)]. [Source: SWISSPROT; Acc: P07814] | 1245 |
| CaMax: 1299c | WD REPEAT AND FYVE DOMAIN CONTAINING 3 ISOFORM 1. [Source: RefSeq; Acc: NM_014991] | 316 |
| CaMax: 1304a | AMISYN; SYNTAXIN BINDING PROTEIN 6. [Source: RefSeq; Acc: NM_014178] | 1371 |
| CaMax: 1322c | UDP-N-ACETYLGLUCOSAMINE--PEPTIDE N-ACETYLGLUCOSAMINYLTRANSFERASE 110 KDA SUBUNIT (EC 2.4.1.—) (O-GLCNAC TRANSFERASE P110 SUBUNIT). [Source: SWISSPROT; Acc: P56558] | 1372 |
| CaMax: 1341a | CYSTEINE KNOT SUPERFAMILY 1, BMP ANTAGONIST 1; GREMLIN. [Source: RefSeq; Acc: NM_013372] | 1269 |
| CaMax: 1354a | TIGGER TRANSPOSABLE ELEMENT DERIVED 1; JERKY (MOUSE) HOMOLOG-LIKE. [Source: RefSeq; Acc: NM_145702] | 370 |
| CaMax: 1361a | ALPHA-(1,6)-FUCOSYLTRANSFERASE (EC 2.4.1.68) (GLYCOPROTEIN 6-ALPHA-L-FUCOSYLTRANSFERASE) (GDP-FUCOSE--GLYCOPROTEIN FUCOSYLTRANSFERASE) (GDP-L-FUC: N-ACETYL-BETA-D-GLUCOSAMINIDE ALPHA1,6-FUCOSYLTRANSFERASE) (ALPHA1-6FUCT) (FUCOSYLTRANSFERASE 8). [Source: SWISSPROT; Acc: Q9BYC5] | 1189 |
| CaMax: 1366a | CONNECTIVE TISSUE GROWTH FACTOR-LIKE PROTEIN PRECURSOR (CTGF-L) (WNT1 INDUCIBLE SIGNALING PATHWAY PROTEIN 2) (WISP-2) (CONNECTIVE TISSUE GROWTH FACTOR-RELATED PROTEIN 58). [Source: SWISSPROT; Acc: O76076] | 209 |
| CaMax: 1371a | CATENIN (CADHERIN-ASSOCIATED PROTEIN), ALPHA-LIKE 1; ALPHA-CATULIN. [Source: RefSeq; Acc: NM_003798] | 392 |
| CaMax: 137b | M-PHASE PHOSPHOPROTEIN 8 (FRAGMENT). [Source: SWISSPROT; Acc: Q99549] | 491 |
| CaMax: 1383a | ECOTROPIC VIRAL INTEGRATION SITE 5; NEUROBLASTOMA STAGE 4S GENE. [Source: RefSeq; Acc: NM_005665] | 911 |
| CaMax: 1384a | ACYL-COA DESATURASE (EC 1.14.19.1) (STEAROYL-COA DESATURASE) (FATTY ACID DESATURASE) (DELTA(9)-DESATURASE). [Source: SWISSPROT; Acc: O00767] | 1330 |
| CaMax: 1397b | NUCLEAR RECEPTOR COACTIVATOR 7; ESTROGEN RECEPTOR ASSOCIATED PROTEIN 140 KDA. [Source: RefSeq; Acc: NM_181782] | 858 |
| CaMax: 1401c | PDZ DOMAIN CONTAINING GUANINE NUCLEOTIDE EXCHANGE FACTOR (GEF) 1; RA(RAS/RAP1A-ASSOCIATING)-GEF; PDZ DOMAIN CONTAINING GUANINE NUCLEOTIDE EXCHANGE FACTOR(GEF)1; RA(RAS/RAP1A-ASSOCIATING)-GEF; PDZ DOMAIN CONTAINING GUANINE NUCLEOTIDE EXCHANGE FACTOR(GEF)1. [Source: RefSeq; Acc: NM_014247] | 306 |
| CaMax: 1409b | BAG-FAMILY MOLECULAR CHAPERONE REGULATOR-5 (BAG-5). [Source: SWISSPROT; Acc: Q9UL15] | 853 |
| CaMax: 1411a | PROTEIN PHOSPHATASE 1, REGULATORY (INHIBITOR) SUBUNIT 12A; MYOSIN PHOSPHATASE, TARGET SUBUNIT 1. [Source: RefSeq; Acc: NM_002480] | 1247 |
| CaMax: 1420c | CELL CYCLE PROGRESSION 8 PROTEIN. [Source: RefSeq; Acc: NM_020739] | 981 |
| CaMax: 1421a | MUCOSA ASSOCIATED LYMPHOID TISSUE LYMPHOMA TRANSLOCATION PROTEIN 1 (EC 3.4.22.—) (MALT-LYMPHOMA ASSOCIATED TRANSLOCATION) (PARACASPASE). [Source: SWISSPROT; Acc: Q9UDY8] | 1248 |

TABLE 6-continued

| CaMax Gene ID | Description | SEQ ID NO |
|---|---|---|
| CaMax: 143.2c | SPARC-LIKE PROTEIN 1 PRECURSOR (HIGH ENDOTHELIAL VENULE PROTEIN) (HEVIN) (MAST 9). [Source: SWISSPROT; Acc: Q14515] | 145 |
| CaMax: 143.2c | SPARC-LIKE PROTEIN 1 PRECURSOR (HIGH ENDOTHELIAL VENULE PROTEIN) (HEVIN) (MAST 9). [Source: SWISSPROT; Acc: Q14515] | 145 |
| CaMax: 1448a | TESTICAN-3 PRECURSOR. [Source: SWISSPROT; Acc: Q9BQ16] | 969 |
| CaMax: 1449a | ZINC FINGER PROTEIN CLONE 647. [Source: SWISSPROT; Acc: P15622] | 1270 |
| CaMax: 1450a | CYTOKINE-LIKE PROTEIN C17 PRECURSOR. [Source: SWISSPROT; Acc: Q9NRR1] | 1450 |
| CaMax: 1459c | ACTIVATED RNA POLYMERASE II TRANSCRIPTIONAL COACTIVATOR P15 (PC4) (P14). [Source: SWISSPROT; Acc: P53999] | 850 |
| CaMax: 145b | 60S RIBOSOMAL PROTEIN L10 (QM PROTEIN) (TUMOR SUPPRESSOR QM) (LAMININ RECEPTOR HOMOLOG). [Source: SWISSPROT; Acc: P27635] | 455 |
| CaMax: 1469a | UPREGULATED DURING SKELETAL MUSCLE GROWTH 5. [Source: RefSeq; Acc: NM_023211] | 847 |
| CaMax: 1469a | UPREGULATED DURING SKELETAL MUSCLE GROWTH 5. [Source: RefSeq; Acc: NM_023211] | 847 |
| CaMax: 1476a | DNA-BINDING PROTEIN INHIBITOR ID-4. [Source: SWISSPROT; Acc: P47928] | 846 |
| CaMax: 1477a | BTG2 PROTEIN (NGF-INDUCIBLE ANTI-PROLIFERATIVE PROTEIN PC3). [Source: SWISSPROT; Acc: P78543] | 276 |
| CaMax: 1481c | HOMEOBOX PROTEIN HOX-A3 (HOX-1E). [Source: SWISSPROT; Acc: O43365] | 23 |
| CaMax: 1488b | HETEROGENEOUS NUCLEAR RIBONUCLEOPROTEINS A2/B1 (HNRNP A2/HNRNP B1). [Source: SWISSPROT; Acc: P22626] | 195 |
| CaMax: 150a | NADP-DEPENDENT LEUKOTRIENE B4 12-HYDROXYDEHYDROGENASE (EC 1.1.1.—). [Source: SWISSPROT; Acc: Q14914] | 458 |
| CaMax: 1521b | PROTEIN PHOSPHATASE METHYLESTERASE-1. [Source: RefSeq; Acc: NM_016147] | 147 |
| CaMax: 1546b | CYSTINE/GLUTAMATE TRANSPORTER (AMINO ACID TRANSPORT SYSTEM XC-) (XCT) (CALCIUM CHANNEL BLOCKER RESISTANCE PROTEIN CCBR1). [Source: SWISSPROT; Acc: Q9UPY5] | 1199 |
| CaMax: 1551a | BTB (POZ) DOMAIN CONTAINING 5. [Source: RefSeq; Acc: NM_017658] | 223 |
| CaMax: 1577a | TRANSMEMBRANE PROTEIN 4. [Source: RefSeq; Acc: NM_014255] | 1464 |
| CaMax: 1631d | UNC-51-LIKE KINASE 2. [Source: RefSeq; Acc: NM_014683] | 119 |
| CaMax: 1635a | UNC-51-LIKE KINASE 2. [Source: RefSeq; Acc: NM_014683] | 1550 |
| CaMax: 1635a | UNC-51-LIKE KINASE 2. [Source: RefSeq; Acc: NM_014683] | 1550 |
| CaMax: 164c | MACROPHAGE INFLAMMATORY PROTEIN-2-BETA PRECURSOR (MIP2-BETA) (CXCL3) (GROWTH REGULATED PROTEIN GAMMA) (GRO-GAMMA). [Source: SWISSPROT; Acc: P19876] | 465 |
| CaMax: 1690a | CYTOCHROME C OXIDASE SUBUNIT IV ISOFORM 1, MITOCHONDRIAL PRECURSOR (EC 1.9.3.1) (COX IV-1) (CYTOCHROME C OXIDASE POLYPEPTIDE IV). [Source: SWISSPROT; Acc: P10888] | 1379 |
| CaMax: 1692a | CYTOCHROME C OXIDASE SUBUNIT IV ISOFORM 1, MITOCHONDRIAL PRECURSOR (EC 1.9.3.1) (COX IV-1) (CYTOCHROME C OXIDASE POLYPEPTIDE IV). [Source: SWISSPROT; Acc: P10888] | 1380 |
| CaMax: 1693b | FIBROBLAST GROWTH FACTOR RECEPTOR 2 PRECURSOR (EC 2.7.1.112) (FGFR-2) (KERATINOCYTE GROWTH FACTOR RECEPTOR 2). [Source: SWISSPROT; Acc: P21802] | 1333 |
| CaMax: 1705a | CASPASE RECRUITMENT DOMAIN PROTEIN 6. [Source: SWISSPROT; Acc: Q9BX69] | 1132 |
| CaMax: 1717a | T-CELL ACTIVATION PROTEIN. [Source: RefSeq; Acc: NM_033296] | 1060 |
| CaMax: 1721a | LEUKOCYTE ELASTASE INHIBITOR (LEI) (MONOCYTE/NEUTROPHIL ELASTASE INHIBITOR) (M/NEI) (EI). [Source: SWISSPROT; Acc: P30740] | 1064 |
| CaMax: 1722a | GOLGI AUTOANTIGEN, GOLGIN SUBFAMILY A MEMBER 4 (TRANS-GOLGI P230) (256 KDA GOLGIN) (GOLGIN-245) (72.1 PROTEIN). [Source: SWISSPROT; Acc: Q13439] | 1065 |
| CaMax: 1724a | G-PROTEIN COUPLED RECEPTOR. [Source: RefSeq; Acc: NM_153832] | 1066 |
| CaMax: 1727a | EGF-LIKE MODULE-CONTAINING MUCIN-LIKE RECEPTOR 3 ISOFORM A. [Source: RefSeq; Acc: NM_032571] | 29 |

TABLE 6-continued

| CaMax Gene ID | Description | SEQ ID NO |
|---|---|---|
| CaMax: 1744a | LEUCINE-RICH REPEAT-CONTAINING G PROTEIN-COUPLED RECEPTOR 4 PRECURSOR (G PROTEIN-COUPLED RECEPTOR 48). [Source: SWISSPROT; Acc: Q9BXB1] | 325 |
| CaMax: 174a | TRANSCRIPTION INITIATION FACTOR IIF, BETA SUBUNIT (TFIIF-BETA) (TRANSCRIPTION INITIATION FACTOR RAP30). [Source: SWISSPROT; Acc: P13984] | 243 |
| CaMax: 1758a | U1 SMALL NUCLEAR RIBONUCLEOPROTEIN 70 KDA (U1 SNRNP 70 KDA) (SNRNP70) (U1-70K). [Source: SWISSPROT; Acc: P08621] | 340 |
| CaMax: 1759b | BTB (POZ) DOMAIN CONTAINING 5. [Source: RefSeq; Acc: NM_017658] | 1479 |
| CaMax: 1775a | GOLGI COILED COIL PROTEIN 1. [Source: SWISSPROT; Acc: Q96CN9] | 1481 |
| CaMax: 1775a | GOLGI COILED COIL PROTEIN 1. [Source: SWISSPROT; Acc: Q96CN9] | 1481 |
| CaMax: 1782b | OK/SW-CL.87. [Source: SPTREMBL; Acc: Q8NI68] | 1136 |
| CaMax: 178a | TRANSCRIPTION FACTOR CP2; TRANSCRIPTION FACTOR CP2, ALPHA GLOBIN. [Source: RefSeq; Acc: NM_005653] | 295 |
| CaMax: 1801b | ATP-DEPENDENT CLP PROTEASE ATP-BINDING SUBUNIT CLPX-LIKE, MITOCHONDRIAL PRECURSOR. [Source: SWISSPROT; Acc: O76031] | 89 |
| CaMax: 180a | TIGGER TRANSPOSABLE ELEMENT DERIVED 1; JERKY (MOUSE) HOMOLOG-LIKE. [Source: RefSeq; Acc: NM_145702] | 472 |
| CaMax: 1812b | SIALIC ACID BINDING IG-LIKE LECTIN 6 PRECURSOR (SIGLEC-6) (OBESITY-BINDING PROTEIN 1) (OB-BP1) (CD33 ANTIGEN-LIKE 1). [Source: SWISSPROT; Acc: O43699] | 272 |
| CaMax: 1814c | PEPTIDYL-GLYCINE ALPHA-AMIDATING MONOOXYGENASE PRECURSOR (EC 1.14.17.3) (PAM). [Source: SWISSPROT; Acc: P19021] | 39 |
| CaMax: 1828b | PROTEOGLYCAN LINK PROTEIN PRECURSOR (CARTILAGE LINK PROTEIN) (LP). [Source: SWISSPROT; Acc: Q9QUP5] | 1283 |
| CaMax: 1853a | SPLICEOSOMAL PROTEIN SAP155 (FRAGMENT). [Source: SPTREMBL; Acc: Q9ET34] | 263 |
| CaMax: 1857c | CYTOCHROME B5. [Source: SWISSPROT; Acc: P00173] | 15 |
| CaMax: 1859a | MYELOID/LYMPHOID OR MIXED-LINEAGE LEUKEMIA 3; ALR-LIKE PROTEIN. [Source: RefSeq; Acc: NM_021230] | 983 |
| CaMax: 1917f | SNF2 HISTONE LINKER PHD RING HELICASE. [Source: RefSeq; Acc: NM_173082] | 133 |
| CaMax: 1919a | ENDOTHELIAL AND SMOOTH MUSCLE CELL-DERIVED NEUROPILIN-LIKE PROTEIN; COAGULATION FACTOR V/VIII-HOMOLOGY DOMAINS PROTEIN 1. [Source: RefSeq; Acc: NM_080927] | 150 |
| CaMax: 1940e | BETA-TUBULIN COFACTOR E. [Source: RefSeq; Acc: NM_003193] | 24 |
| CaMax: 1941e | CDW92 ANTIGEN; CHOLINE TRANSPORTER-LIKE PROTEIN. [Source: RefSeq; Acc: NM_080546] | 314 |
| CaMax: 1943a | ALPHA-ACTININ-2-ASSOCIATED LIM PROTEIN; ENIGMA HOMOLOG. [Source: RefSeq; Acc: NM_014476] | 338 |
| CaMax: 1950a | VAV-3 PROTEIN. [Source: SWISSPROT; Acc: Q9UKW4] | 1293 |
| CaMax: 1953a | NGFI-A BINDING PROTEIN 1 (EGR-1 BINDING PROTEIN 1) (TRANSCRIPTIONAL REGULATORY PROTEIN P54). [Source: SWISSPROT; Acc: Q13506] | 371 |
| CaMax: 1961e | MOTHERS AGAINST DECAPENTAPLEGIC HOMOLOG INTERACTING PROTEIN (MADH-INTERACTING PROTEIN) (SMAD ANCHOR FOR RECEPTOR ACTIVATION) (RECEPTOR ACTIVATION ANCHOR) (HSARA) (NOVEL SERINE PROTEASE) (NSP). [Source: SWISSPROT; Acc: O95405] | 1494 |
| CaMax: 1967a | ANTIGEN PEPTIDE TRANSPORTER 2 (APT2) (PEPTIDE TRANSPORTER TAP2) (PEPTIDE TRANSPORTER PSF2) (PEPTIDE SUPPLY FACTOR 2) (PSF-2) (PEPTIDE TRANSPORTER INVOLVED IN ANTIGEN PROCESSING 2). [Source: SWISSPROT; Acc: Q03519] | 1083 |
| CaMax: 1968a | PELLINO PROTEIN. [Source: RefSeq; Acc: NM_020651] | 1084 |
| CaMax: 1982a | COLLAGEN ALPHA 1(XI) CHAIN PRECURSOR. [Source: SWISSPROT; Acc: P12107] | 1088 |
| CaMax: 1990a | MICROTUBULE-ASSOCIATED PROTEIN, RP/EB FAMILY, MEMBER 2; T-CELL ACTIVATION PROTEIN, EB1 FAMILY; APC-BINDING PROTEIN EB1. [Source: RefSeq; Acc: NM_014268] | 1092 |
| CaMax: 2008a | PINS. [Source: RefSeq; Acc: NM_029522] | 1498 |
| CaMax: 2013a | NUCLEAR FACTOR RIP140 (NUCLEAR RECEPTOR INTERACTING PROTEIN 1). [Source: SWISSPROT; Acc: P48552] | 1499 |
| CaMax: 2015e | 60S RIBOSOMAL PROTEIN L4 (L1). [Source: SWISSPROT; Acc: P36578] | 233 |

TABLE 6-continued

| CaMax Gene ID | Description | SEQ ID NO |
|---|---|---|
| CaMax: 2020b | MITOGEN-ACTIVATED PROTEIN KINASE KINASE KINASE KINASE 3 (EC 2.7.1.37) (MAPK/ERK KINASE KINASE KINASE 3) (MEK KINASE KINASE 3) (MEKKK 3) (GERMINAL CENTER KINASE RELATED PROTEIN KINASE) (GLK). [Source: SWISSPROT; Acc: Q8IVH8] | 284 |
| CaMax: 2034a | LATE ENVELOPE PROTEIN 4. [Source: RefSeq; Acc: NM_178352] | 1501 |
| CaMax: 2035d | DNA-DIRECTED RNA POLYMERASES III 12.5 KDA POLYPEPTIDE (EC 2.7.7.6) (RNA POLYMERASE III C11 SUBUNIT) (HSC11P) (HRPC11) (MY010 PROTEIN). [Source: SWISSPROT; Acc: Q9Y2Y1] | 149 |
| CaMax: 2056d | POTENTIAL HELICASE WITH ZINC-FINGER DOMAIN. [Source: SWISSPROT; Acc: P42694] | 1305 |
| CaMax: 2070a | PALLADIN; CGI-151 PROTEIN. [Source: RefSeq; Acc: NM_016081] | 1307 |
| CaMax: 2074b | POTENTIAL PHOSPHOLIPID-TRANSPORTING ATPASE IA (EC 3.6.3.1) (CHROMAFFIN GRANULE ATPASE II) (ATPASE CLASS I TYPE 8A MEMBER 1). [Source: SWISSPROT; Acc: Q9Y2Q0] | 99 |
| CaMax: 2078a | SEPTIN 7 (CDC10 PROTEIN HOMOLOG). [Source: SWISSPROT; Acc: Q16181] | 1098 |
| CaMax: 2083e | WD REPEAT AND FYVE DOMAIN CONTAINING 1 ISOFORM 1; PHOSPHOINOSITIDE-BINDING PROTEIN SR1; WD40 AND FYVE DOMAIN CONTAINING 1. [Source: RefSeq; Acc: NM_020830] | 113 |
| CaMax: 2100b | FIBRILLIN 1 PRECURSOR. [Source: SWISSPROT; Acc: P35555] | 1104 |
| CaMax: 2110a | ZINC FINGER PROTEIN 345 (ZINC FINGER PROTEIN HZF10). [Source: SWISSPROT; Acc: Q14585] | 989 |
| CaMax: 211b | MULTIDRUG RESISTANCE-ASSOCIATED PROTEIN 1. [Source: SWISSPROT; Acc: P33527] | 505 |
| CaMax: 2123a | PEPTIDE-HISTIDINE TRANSPORTER 4. [Source: RefSeq; Acc: NM_145648] | 1557 |
| CaMax: 2129a | SMALL PROTEIN EFFECTOR 1 OF CDC42. [Source: RefSeq; Acc: NM_020239] | 990 |
| CaMax: 2224a | PROTEOGLYCAN 4; MEGAKARYOCYTE STIMULATING FACTOR; PROTEOGLYCAN 4, (MEGAKARYOCYTE STIMULATING FACTOR, ARTICULAR SUPERFICIAL ZONE PROTEIN); JACOBS CAMPTODACTYLY-ARTHIROPATHY-PERICARDITIS SYNDROME; CAMPTODACTYLY, ARTHROPATHY, COXA VARA, PERICARDITIS SYNDROME. [Source: RefSeq; Acc: NM_005807] | 215 |
| CaMax: 2234a | THYROTROPIN-RELEASING HORMONE RECEPTOR (TRH-R) (THYROLIBERIN RECEPTOR). [Source: SWISSPROT; Acc: P21761] | 994 |
| CaMax: 2238a | CGMP-INHIBITED 3',5'-CYCLIC PHOSPHODIESTERASE A (EC 3.1.4.17) (CYCLIC GMP INHIBITED PHOSPHODIESTERASE A) (CGI-PDE A). [Source: SWISSPROT; Acc: Q14432] | 996 |
| CaMax: 2241a | CGMP-INHIBITED 3',5'-CYCLIC PHOSPHODIESTERASE A (EC 3.1.4.17) (CYCLIC GMP INHIBITED PHOSPHODIESTERASE A) (CGI-PDE A). [Source: SWISSPROT; Acc: Q14432] | 188 |
| CaMax: 2238a | CGMP-INHIBITED 3',5'-CYCLIC PHOSPHODIESTERASE A (EC 3.1.4.17) (CYCLIC GMP INHIBITED PHOSPHODIESTERASE A) (CGI-PDE A). [Source: SWISSPROT; Acc: Q14432] | 996 |
| CaMax: 2267a | THROMBOSPONDIN 1 PRECURSOR. [Source: SWISSPROT; Acc: P07996] | 999 |
| CaMax: 2241a | CGMP-INHIBITED 3',5'-CYCLIC PHOSPHODIESTERASE A (EC 3.1.4.17) (CYCLIC GMP INHIBITED PHOSPHODIESTERASE A) (CGI-PDE A). [Source: SWISSPROT; Acc: Q14432] | 188 |
| CaMax: 2374a | THROMBOSPONDIN 1 PRECURSOR. [Source: SWISSPROT; Acc: P07996] | 206 |
| CaMax: 239a | SPECTRIN ALPHA CHAIN, BRAIN (SPECTRIN, NON-ERYTHROID ALPHA CHAIN) (ALPHA-II SPECTRIN) (FODRIN ALPHA CHAIN). [Source: SWISSPROT; Acc: Q13813] | 530 |
| CaMax: 23a | GLUCOCORTICOID MODULATORY ELEMENT BINDING PROTEIN 1 (GMEB-1) (PARVOVIRUS INITIATION FACTOR P96) (PIF P96) (DNA BINDING PROTEIN P96PIF). [Source: SWISSPROT; Acc: Q9Y692] | 90 |
| CaMax: 267d | TENASCIN PRECURSOR (TN) (HEXABRACHION) (CYTOTACTIN) (NEURONECTIN) (GMEM) (JI) (MIOTENDINOUS ANTIGEN) (GLIOMA-ASSOCIATED-EXTRACELLULAR MATRIX ANTIGEN) (GP 150-225) (TENASCIN-C) (TN-C). [Source: SWISSPROT; Acc: P24821] | 553 |
| CaMax: 272d | ELAC HOMOLOG 1. [Source: RefSeq; Acc: NM_018696] | 116 |
| CaMax: 307b | PROTEIN CGI-147. [Source: SWISSPROT; Acc: Q9Y3E5] | 598 |
| CaMax: 308c | RETINAL PIGMENT EPITHELIUM-SPECIFIC PROTEIN 65 KDA; RETINAL PIGMENT EPITHELIUM-SPECIFIC PROTEIN (65 KD); RETINITIS PIGMENTOSA 20 (AUTOSOMAL RECESSIVE). [Source: RefSeq; Acc: NM_000329] | 597 |
| CaMax: 320a | EXOCYST COMPLEX COMPONENT SEC3 (BM-012). [Source: SWISSPROT; Acc: Q9NV70] | 1532 |

TABLE 6-continued

| CaMax Gene ID | Description | SEQ ID NO |
|---|---|---|
| CaMax: 326e | MICROSOMAL SIGNAL PEPTIDASE 18 KDA SUBUNIT (EC 3.4.—.—) (SPASE 18 KDA SUBUNIT) (SPC18) (ENDOPEPTIDASE SP18). [Source: SWISSPROT; Acc: Q9R0P6] | 71 |
| CaMax: 328b | PALLADIN; CGI-151 PROTEIN. [Source: RefSeq; Acc: NM_016081] | 591 |
| CaMax: 106a | FERRITIN HEAVY CHAIN (FERRITIN H SUBUNIT). [Source: SWISSPROT; Acc: P02794] | 440 |
| CaMax: 364a | RNA-BINDING PROTEIN EWS (EWS ONCOGENE) (EWING SARCOMA BREAKPOINT REGION 1 PROTEIN). [Source: SWISSPROT; Acc: Q01844] | 640 |
| CaMax: 374a | ACIDIC LEUCINE-RICH NUCLEAR PHOSPHOPROTEIN 32 FAMILY MEMBER B (PHAPI2 PROTEIN) (SILVER-STAINABLE PROTEIN SSP29) (ACIDIC PROTEIN RICH IN LEUCINES). [Source: SWISSPROT; Acc: Q92688] | 644 |
| CaMax: 38a | FIP1-LIKE 1; REARRANGED IN HYPEREOSINOPHILIA. [Source: RefSeq; Acc: NM_030917] | 423 |
| CaMax: 415b | EUKARYOTIC TRANSLATION INITIATION FACTOR 2 SUBUNIT 1 (EUKARYOTIC TRANSLATION INITIATION FACTOR 2 ALPHA SUBUNIT) (EIF-2-ALPHA) (EIF-2ALPHA) (EIF-2A). [Source: SWISSPROT; Acc: P05198] | 913 |
| CaMax: 459a | NUCLEAR FACTOR OF ACTIVATED T CELLS 5 (T CELL TRANSCRIPTION FACTOR NFAT5) (NF-AT5) (TONICITY-RESPONSIVE ENHANCER-BINDING PROTEIN) (TONE-BINDING PROTEIN) (TONEBP). [Source: SWISSPROT; Acc: O94916] | 658 |
| CaMax: 464b | ADENYLOSUCCINATE SYNTHETASE (EC 6.3.4.4) (IMP--ASPARTATE LIGASE) (ADSS) (AMPSASE). [Source: SWISSPROT; Acc: P30520] | 292 |
| CaMax: 465b | SURFACE GLYCOPROTEIN, IG SUPERFAMILY MEMBER. [Source: RefSeq; Acc: NM_016952] | 193 |
| CaMax: 478a | T-COMPLEX ASSOCIATED-TESTIS-EXPRESSED 1-LIKE (PROTEIN 91/23). [Source: SWISSPROT; Acc: P51808] | 662 |
| CaMax: 479c | T-COMPLEX ASSOCIATED-TESTIS-EXPRESSED 1-LIKE (PROTEIN 91/23). [Source: SWISSPROT; Acc: P51808] | 129 |
| CaMax: 487a | RHO GUANINE NUCLEOTIDE EXCHANGE FACTOR 2 (GEF-H1 PROTEIN) (PROLIFERATING CELL NUCLEOLAR ANTIGEN P40). [Source: SWISSPROT; Acc: Q92974] | 668 |
| CaMax: 488a | HEXOKINASE, TYPE II (EC 2.7.1.1) (HK II) (MUSCLE FORM HEXOKINASE). [Source: SWISSPROT; Acc: P52789] | 669 |
| CaMax: 520a | BTB (POZ) DOMAIN CONTAINING 5. [Source: RefSeq; Acc: NM_017658] | 622 |
| CaMax: 521b | MYOCYTE-SPECIFIC ENHANCER FACTOR 2C. [Source: SWISSPROT; Acc: Q06413] | 621 |
| CaMax: 530b | PROTEASOME SUBUNIT ALPHA TYPE 3 (EC 3.4.25.1) (PROTEASOME COMPONENT C8) (MACROPAIN SUBUNIT C8) (MULTICATALYTIC ENDOPEPTIDASE COMPLEX SUBUNIT C8). [Source: SWISSPROT; Acc: P25788] | 9 |
| CaMax: 539a | HDCMD38P. [Source: SPTREMBL; Acc: Q9P1S5] | 612 |
| CaMax: 545a | TRANSMEMBRANE PROTEIN 4. [Source: RefSeq; Acc: NM_014255] | 670 |
| CaMax: 550a | SER/ARG-RELATED NUCLEAR MATRIX PROTEIN (PLENTY OF PROLINES 101-L; SER/ARG-RELATED NUCLEAR MATRIX PROTEIN (PLENTY OF PROLINES 101-LIKE). [Source: RefSeq; Acc: NM_005839] | 1403 |
| CaMax: 555b | F-BOX AND LEUCINE-RICH REPEAT PROTEIN 3A; F-BOX PROTEIN FBL3A. [Source: RefSeq; Acc: NM_012158] | 114 |
| CaMax: 571a | ECHINODERM MICROTUBULE-ASSOCIATED PROTEIN-LIKE 4 (EMAP-4) (RESTRICTEDLY OVEREXPRESSED PROLIFERATION-ASSOCIATED PROTEIN) (ROPP 120). [Source: SWISSPROT; Acc: Q9HC35] | 673 |
| CaMax: 579a | SPLICING FACTOR, ARGININE/SERINE-RICH 6 (PRE-MRNA SPLICING FACTOR SRP55). [Source: SWISSPROT; Acc: Q13247] | 676 |
| CaMax: 57a | INTEGRIN ALPHA-6 PRECURSOR (VLA-6) (CD49F). [Source: SWISSPROT; Acc: P23229] | 417 |
| CaMax: 581a | LBP-9. [Source: RefSeq; Acc: NM_014553] | 80 |
| CaMax: 597c | FETAL ALZHEIMER ANTIGEN (FETAL ALZ-50-REACTIVE CLONE 1). [Source: SWISSPROT; Acc: Q12830] | 312 |
| CaMax: 623a | RAS GTPASE-ACTIVATING-LIKE PROTEIN IQGAP1 (P195). [Source: SWISSPROT; Acc: P46940] | 1022 |
| CaMax: 628a | KREMEN PROTEIN 1 PRECURSOR (KRINGLE-CONTAINING PROTEIN MARKING THE EYE AND THE NOSE) (DICKKOPF RECEPTOR). [Source: SWISSPROT; Acc: Q96MU8] | 1046 |
| CaMax: 635a | SER/ARG-RELATED NUCLEAR MATRIX PROTEIN (PLENTY OF PROLINES 101-L; SER/ARG-RELATED NUCLEAR MATRIX PROTEIN (PLENTY OF PROLINES 101-LIKE). [Source: RefSeq; Acc: NM_005839] | 1404 |

TABLE 6-continued

| CaMax Gene ID | Description | SEQ ID NO |
|---|---|---|
| CaMax: 638b | T-COMPLEX ASSOCIATED-TESTIS-EXPRESSED 1-LIKE (PROTEIN 91/23). [Source: SWISSPROT; Acc: P51808] | 261 |
| CaMax: 685a | UPF0183 PROTEIN. [Source: SWISSPROT; Acc: Q9BSU1] | 683 |
| CaMax: 692a | TIGGER TRANSPOSABLE ELEMENT DERIVED 1; JERKY (MOUSE) HOMOLOG-LIKE. [Source: RefSeq; Acc: NM_145702] | 688 |
| CaMax: 704b | INVERSIN. [Source: RefSeq; Acc: NM_014425] | 697 |
| CaMax: 704b | INVERSIN. [Source: RefSeq; Acc: NM_014425] | 697 |
| CaMax: 710a | COLLAGEN ALPHA 1(X) CHAIN PRECURSOR. [Source: SWISSPROT; Acc: Q03692] | 701 |
| CaMax: 726b | GRAVE'S DISEASE CARRIER PROTEIN (GDC) (GRAVE'S DISEASE AUTOANTIGEN) (GDA) (MITOCHONDRIAL SOLUTE CARRIER PROTEIN HOMOLOG). [Source: SWISSPROT; Acc: P16260] | 1405 |
| CaMax: 736a | DIAMINE ACETYLTRANSFERASE (BC 2.3.1.57) (SPERMIDINE/SPERMINE N(1)-ACETYLTRANSFERASE) (SSAT) (PUTRESCINE ACETYLTRANSFERASE). [Source: SWISSPROT; Acc: P21673] | 142 |
| CaMax: 73b | HISTIDINE-RICH MEMBRANE PROTEIN KE4. [Source: SWISSPROT; Acc: Q92504] | 408 |
| CaMax: 747a | IDN3 PROTEIN ISOFORM A. [Source: RefSeq; Acc: NM_133433] | 126 |
| CaMax: 785b | MAJOR PRION PROTEIN PRECURSOR (PRP) (PRP27-30) (PRP33-35C) (ASCR) (CD230 ANTIGEN). [Source: SWISSPROT; Acc: P04156] | 268 |
| CaMax: 794a | SARCOSPAN (K-RAS ONCOGENE-ASSOCIATED PROTEIN) (KIRSTEN-RAS-ASSOCIATED PROTEIN). [Source: SWISSPROT; Acc: Q14714] | 372 |
| CaMax: 85.1c | NITROGEN FIXATION CLUSTER-LIKE. [Source: RefSeq; Acc: NM_014301] | 72 |
| CaMax: 856c | BRANCHED-CHAIN AMINO ACID AMINOTRANSFERASE, CYTOSOLIC (EC 2.6.1.42) (BCAT(C)) (ECA39 PROTEIN). [Source: SWISSPROT; Acc: P54687] | 1130 |
| CaMax: 863c | ZINC FINGER PROTEIN SLUG (NEURAL CREST TRANSCRIPTION FACTOR SLUG) (SNAIL HOMOLOG 2). [Source: SWISSPROT; Acc: P97469] | 916 |
| CaMax: 890a | RAS-RELATED PROTEIN RAB-6A (RAB-6). [Source: SWISSPROT; Acc: P20340] | 161 |
| CaMax: 909a | PEPTIDYL-GLYCINE ALPHA-AMIDATING MONOOXYGENASE PRECURSOR (EC 1.14.17.3) (PAM). [Source: SWISSPROT; Acc: P19021] | 786 |
| CaMax: 90c | HEAT SHOCK PROTEIN HSP 90-BETA (HSP 84) (TUMOR SPECIFIC TRANSPLANTATION 84 KDA ANTIGEN) (TSTA). [Source: SWISSPROT; Acc: P11499] | 400 |
| CaMax: 919b | MYELIN GENE EXPRESSION FACTOR 2. [Source: RefSeq; Acc: NM_016132] | 777 |
| CaMax: 92c | NUCLEAR RECEPTOR COACTIVATOR 1 ISOFORM 1. [Source: RefSeq; Acc: NM_003743] | 398 |
| CaMax: 935b | CHURCHILL PROTEIN (MY015 PROTEIN). [Source: SWISSPROT; Acc: Q8WUH1] | 767 |
| CaMax: 953a | 6.8 KDA MITOCHONDRIAL PROTEOLIPID. [Source: SWISSPROT; Acc: P56379] | 759 |
| CaMax: 963c | PUMILIO HOMOLOG 1. [Source: RefSeq; Acc: NM_014676] | 755 |
| CaMax: 986a | G1/S-SPECIFIC CYCLIN D2. [Source: SWISSPROT; Acc: P30279] | 1423 |
| CaMax: 990a | TRANSCRIPTION FACTOR SOX-9. [Source: SWISSPROT; Acc: P48436] | 194 |
| CaMax: 994b | INHIBITOR OF BRUTON'S TYRSOINE KINASE; BTK-BINDING PROTEIN. [Source: RefSeq; Acc: NM_015525] | 257 |
| CaMax: 996a | 40S RIBOSOMAL PROTEIN S20. [Source: SWISSPROT; Acc: P17075] | 930 |

EXAMPLE 3

Preparation of Microarray

Microarray probes were generated by PCR-amplifying clones isolated from differential display. Probes were spotted in duplicate onto poly-L-lysine coated slides using a GMS417 (Affymetrix) arrayer. Osteoarthritic cartilage samples were obtained from the femoral heads of clinically diagnosed canines undergoing total flip replacement. RNA was hybridized to the slides using the HC ExpressArray (Digene) kit and visualized using a GMS418 (Affymetrix) scanner. The Imagene (Biodiscovery) program was used for spot finding and subsequent data analysis was performed using GeneSight (Biodiscovery). Expression levels are represented after background subtraction, log(base 2) transformation and global slide signal normalization.

Microarray Clone Preparation

Culture blocks containing 1.5 mLs of Magnificent Broth (MB) plus tetracycline (50 mg/mL) were inoculated with appropriate clones from glycerol stocks and grown overnight with shaking at 37° C. These cultures were used to inoculate a second culture block that was grown for approximately 6 hours with shaking at 37° C. These 6-hour cultures were used to inoculate 2 replicate culture blocks which were grown overnight with shaking at 37° C. Cultures were centrifuged to pellet cells and plasmids isolated using the Qiagen 96-well culture system (Qiagen). Plasmid concentrations were determined using a spectrophotometer by measuring the absorbance at 260 nm. All cDNA plasmid clones were amplified in duplicate using the following PCR reaction (final concentration): 10×PCR buffer (10 mM Tris-HCl, pH 8.3, 50 mM KCl, 2.5 mM $MgCl_2$), 500 uM ea. dNTP, 600 nM Rgh primer, 600 nM Lgh primer, 1 µL (5 units/µL) of Eppendorf Taq polymerase and 1 µL (~100 ng/µL) cDNA template in a total of 100 µL. The reaction was performed in the following conditions: 94° C. 30 seconds, 52° C. 40 seconds, 72° C. 1 minute for 40 cycles, followed by 72° C.-5 min and 4° C.-hold. Amplified products were verified on 1.5% agarose gel and purified using Minelute (Qiagen) protocol. The 200 µL of PCR was added to the filter plate and vacuum was turned on to pull through all PCR reagents and liquid leaving only the cDNA bound to the filter. 30 µL molecular grade water was added to the filter plate and incubated at room temperature on an orbital shaker at 900 rpm for 5 minutes. The supernatant containing the purified cDNA was aspirated from the filter plate. The cDNA's were dried for 2 hrs or to completion in a speed vac at 45° C. 30 µL Corning Universal Printing Buffer was added to all cDNA's and resuspended over night at room temperature on an orbital shaker. 2 µL's transferred for concentration analysis and the appropriate amount of Corning Universal Printing Buffer was added for a final concentration of 200 to 500 ng/uL. Plates were stored at −20° C. until and after each array printing.

Clone Arraying

Microscope slides (Goldseal cat #3010) were submerged in a 10% NaOH (Fisher cat # S318-500) 57% EtOH solution and incubated at room temperature in an orbital shaker at 50 rpm for 2 hours. Slides were rinsed in Milli-Q water 5× for 30 seconds each. While the slides remain in the last water rinse a 10% Poly-L-Lysine (Sigma cat # P8920), 10% 1×PBS (GibcoBRL cat#70013-032) was brought to 700 mLs using Milli-Q water in plastic ware. Slides were submerged in coating solution and incubated at room temperature in orbital shaker at 50 rpm for 1 hour. Slides were rinsed in Milli-Q water 5× for 30 seconds each and spun at 500 rpm for 1 minute. Slides were incubated in 55° C. oven for 10 min and kept in dessicator for at least 14 days and no longer than 3 months prior to arraying. cDNA clones were arrayed using the GMS 417 arrayer (Affymetrix). All slides were placed in a room temperature dessicator to dry overnight. The slides were rehydrated over boiling Milli-Q water (steam) and snap dried DNA side up on an 80° C. heat block. To ensure efficient cross-linking the slides were baked for 2 hours at 80° C. in an oven and then cross-linked with Stratalinker (120 mJ, Stratagene). All slides were stored in a room temperature dessicator until used for cDNA hybridization.

cDNA Microarray Hybridization

All RNA samples were reverse transcribed using the following reaction: 5× Superscript II First Strand Buffer (Invitrogen), 1 uL (1 pmole/uL) of RT primer (Genisphere), 1 uL Superase-In™ Rnase inhibitor, 1 uL 10 mM ea. DNTP, 2 uL 0.1 M DTT, 1 uL Superscript II and 5 ug total RNA. The reaction was performed at 42° C. for 2 hrs. The reaction was stopped by adding 3.5 uL of 0.5 M NaOH/50 mM EDTA and incubating at 65° C. for 10 minutes. The reaction was neutralized by adding 5 uL of 1M Tris-HCL, pH 7.5. 101.5 uL of 10 mM Tris, pH 8, 1 mM EDTA was added and the cDNA was purified and concentrated by following the Microcon YM-30 (Millipore) protocol. The concentrated cDNA was brought to a final volume of 10 uL with Nuclease-free water and the following reagents added: 20 ul of 2× hybridization buffer (Genisphere), 2 uL dT LNA blocker and 8 uL Nuclease-free water for a total of 40 uL. The hybridization mixture was heated at 80° C. for 10 minutes and loaded onto the microarray slide at the edge of the lifterSlip. The slide was then placed into a GeneMachines dual hybridization chamber and placed in a 60° C. water bath overnight. The following day the slides were processed according to the 3DNA Array 350 (Genisphere) protocol. Briefly, the slides were washed (2×SSC-0.2% SDS, 2×SSC, 0.2×SSC), spun dry at 1000 rpm for 1 min and the 3DNA capture hybridization performed. The slides were washed (2×SSC-0.2% SDS, 2×SSC, 0.2×SSC) spun dry at 1000 rpm for 1 min and scanned using a GMS 418 array scanner (Affymetrix).

Microarray Analysis

Scanned images representing RNA transcripts bound to specific clones were quantified and checked for spot quality control using Imagene analysis software (BioDiscovery). Quantified images were analyzed using Genesight analysis software (BioDiscovery). The analysis represented subtraction of background surrounding the spots, averaging spot replicates, deletion of clone information representing clone hybridization signals not greater than 200 above background on all samples, log (base 2) transformation and global normalization of each slide (values expressed as percent of average spot intensity).

EXAMPLE 4

Expression Analysis Using Microarray

RNA was extracted from cartilage as described, supra. Microarray analysis (described supra) was performed on 8 osteoarthritic cartilage samples from clinically diagnosed canines undergoing total hip replacement and 8 normal cartilage samples. A standard T-test (two categories) was performed on the final hybridization signals for osteoarthlitic characterization of cartilage samples ($p<0.05$ and $p<0.01$, results shown in Tables 3 and 4, respectively).

TABLE 3

| Gene ID | OA AVG | STD | Normal AVG | STD | DIF(OA-N) | Fold |
|---|---|---|---|---|---|---|
| 1028c | 1.81 | 0.75 | 0.24 | 0.94 | 1.57 | 2.96 |
| 768a | 1.99 | 0.54 | 0.88 | 0.55 | 1.11 | 2.16 |
| 141c | 3.94 | 0.57 | 3.01 | 0.75 | 0.93 | 1.90 |
| 154a | 0.80 | 0.85 | 0.06 | 0.56 | 0.74 | 1.67 |
| 1548c | 5.49 | 0.41 | 4.79 | 0.46 | 0.69 | 1.62 |
| 718a | 5.93 | 0.66 | 5.29 | 0.43 | 0.64 | 1.56 |
| 11b | −0.85 | 0.66 | −1.46 | 0.30 | 0.60 | 1.52 |
| 363a | −0.24 | 0.52 | −0.77 | 0.44 | 0.53 | 1.45 |
| 370a | 6.06 | 0.46 | 5.54 | 0.61 | 0.51 | 1.43 |
| 1551a | 0.71 | 0.51 | 0.23 | 0.49 | 0.48 | 1.40 |
| 376a | −0.66 | 0.42 | −1.01 | 0.24 | 0.36 | 1.28 |
| 84.2c | 0.39 | 0.35 | 0.04 | 0.28 | 0.36 | 1.28 |
| 380a | −1.61 | 0.22 | −1.84 | 0.18 | 0.24 | 1.18 |
| 372a | 0.11 | 0.25 | −0.12 | 0.23 | 0.23 | 1.17 |
| 2148a | −1.81 | 0.23 | −1.62 | 0.15 | −0.20 | 1.15 |
| 1800a | −2.23 | 0.16 | −1.98 | 0.24 | −0.25 | 1.19 |
| 1357a | −2.01 | 0.12 | −1.73 | 0.07 | −0.28 | 1.21 |

TABLE 3-continued

| Gene ID | OA AVG | STD | Normal AVG | STD | DIF(OA-N) | Fold | Gene ID | OA AVG | STD | Normal AVG | STD | DIF(OA-N) | Fold |
|---|---|---|---|---|---|---|---|---|---|---|---|---|---|
| 168c | 5.11 | 0.19 | 5.40 | 0.21 | −0.29 | 1.22 | 556b | −0.33 | 0.54 | 0.13 | 0.43 | −0.47 | 1.38 |
| 1090d | 6.26 | 0.22 | 6.55 | 0.23 | −0.29 | 1.22 | 1711a | −1.92 | 0.24 | −1.45 | 0.44 | −0.47 | 1.38 |
| 60a | −0.18 | 0.34 | 0.11 | 0.25 | −0.29 | 1.22 | 49a | −1.19 | 0.37 | −0.72 | 0.35 | −0.47 | 1.38 |
| 96e | 5.50 | 0.16 | 5.80 | 0.35 | −0.30 | 1.23 | 1271a | −1.92 | 0.26 | −1.45 | 0.36 | −0.47 | 1.39 |
| 2015e | 4.67 | 0.24 | 4.97 | 0.23 | −0.30 | 1.23 | 1612a | −0.56 | 0.41 | −0.09 | 0.28 | −0.47 | 1.39 |
| 383d | −1.78 | 0.18 | −1.47 | 0.14 | −0.30 | 1.24 | 1497c | −2.07 | 0.35 | −1.59 | 0.35 | −0.47 | 1.39 |
| 128a | 2.10 | 0.39 | 2.41 | 0.24 | −0.31 | 1.24 | 14a | −0.93 | 0.24 | −0.45 | 0.30 | −0.47 | 1.39 |
| 621b | −2.03 | 0.27 | −1.72 | 0.35 | −0.32 | 1.25 | 967b | −1.87 | 0.33 | −1.39 | 0.42 | −0.48 | 1.39 |
| 1174d | −0.45 | 0.36 | −0.12 | 0.18 | −0.33 | 1.25 | 1727a | −1.68 | 0.31 | −1.20 | 0.27 | −0.48 | 1.39 |
| 947a | 0.71 | 0.29 | 1.04 | 0.27 | −0.33 | 1.26 | 1329a | −1.64 | 0.39 | −1.16 | 0.51 | −0.48 | 1.39 |
| 1964a | −2.34 | 0.18 | −2.01 | 0.27 | −0.33 | 1.26 | 464b | −1.51 | 0.52 | −1.04 | 0.21 | −0.48 | 1.39 |
| 619b | −2.11 | 0.21 | −1.77 | 0.23 | −0.34 | 1.26 | 1490a | 0.50 | 0.47 | 0.98 | 0.32 | −0.48 | 1.40 |
| 2222b | −0.52 | 0.31 | −0.18 | 0.33 | −0.34 | 1.27 | 188b | −1.65 | 0.31 | −1.17 | 0.46 | −0.48 | 1.40 |
| 1468c | −1.26 | 0.28 | −0.91 | 0.32 | −0.34 | 1.27 | 178a | −1.99 | 0.31 | −1.51 | 0.48 | −0.48 | 1.40 |
| 1629a | −0.78 | 0.36 | −0.44 | 0.17 | −0.34 | 1.27 | 631b | −2.23 | 0.00 | −1.75 | 0.25 | −0.48 | 1.40 |
| 174a | −0.22 | 0.27 | 0.13 | 0.38 | −0.35 | 1.27 | 1244b | −2.03 | 0.35 | −1.55 | 0.42 | −0.48 | 1.40 |
| 2085c | 3.62 | 0.47 | 3.97 | 0.16 | −0.35 | 1.27 | 1220b | 2.96 | 0.46 | 3.44 | 0.15 | −0.48 | 1.40 |
| 1461a | −1.73 | 0.26 | −1.38 | 0.24 | −0.35 | 1.27 | 758b | −0.39 | 0.43 | 0.09 | 0.31 | −0.48 | 1.40 |
| 764b | 1.37 | 0.34 | 1.73 | 0.32 | −0.36 | 1.28 | 1807a | −2.60 | 0.18 | −2.11 | 0.31 | −0.49 | 1.40 |
| 731a | 1.61 | 0.37 | 1.98 | 0.36 | −0.36 | 1.28 | 33a | 1.31 | 0.22 | 1.80 | 0.35 | −0.49 | 1.40 |
| 1051a | 2.30 | 0.34 | 2.67 | 0.36 | −0.36 | 1.29 | 276a | −1.80 | 0.40 | −1.31 | 0.16 | −0.49 | 1.40 |
| 613a | −2.07 | 0.24 | −1.70 | 0.30 | −0.37 | 1.29 | 204a | −1.25 | 0.50 | −0.76 | 0.45 | −0.49 | 1.40 |
| 531a | −0.52 | 0.20 | −0.15 | 0.36 | −0.37 | 1.29 | 543a | −2.07 | 0.39 | −1.58 | 0.37 | −0.49 | 1.40 |
| 1471a | −1.75 | 0.35 | −1.38 | 0.24 | −0.37 | 1.30 | 1764a | −0.26 | 0.37 | 0.23 | 0.41 | −0.49 | 1.40 |
| 1381a | 6.20 | 0.33 | 6.57 | 0.26 | −0.38 | 1.30 | 711a | 4.68 | 0.49 | 5.17 | 0.48 | −0.49 | 1.41 |
| 44c | 4.99 | 0.36 | 5.37 | 0.31 | −0.38 | 1.30 | 35c | −0.93 | 0.53 | −0.44 | 0.29 | −0.49 | 1.41 |
| 1892a | −0.02 | 0.25 | 0.36 | 0.38 | −0.38 | 1.30 | 1401c | −1.65 | 0.43 | −1.16 | 0.48 | −0.49 | 1.41 |
| 76b | −0.54 | 0.41 | −0.16 | 0.19 | −0.38 | 1.30 | 3c | −1.75 | 0.40 | −1.26 | 0.45 | −0.49 | 1.41 |
| 366a | −1.98 | 0.32 | −1.60 | 0.20 | −0.38 | 1.30 | 494a | −1.49 | 0.40 | −1.00 | 0.38 | −0.50 | 1.41 |
| 994b | −1.82 | 0.43 | −1.44 | 0.24 | −0.39 | 1.31 | 1146a | 0.55 | 0.33 | 1.04 | 0.34 | −0.50 | 1.41 |
| 1954e | −1.85 | 0.20 | −1.46 | 0.35 | −0.39 | 1.31 | 1616a | −1.25 | 0.43 | −0.76 | 0.47 | −0.50 | 1.41 |
| 2127c | 0.08 | 0.23 | 0.48 | 0.31 | −0.39 | 1.31 | 1070b | −1.99 | 0.51 | −1.49 | 0.10 | −0.50 | 1.41 |
| 530b | 1.39 | 0.21 | 1.78 | 0.23 | −0.40 | 1.32 | 1738b | −1.57 | 0.25 | −1.07 | 0.36 | −0.50 | 1.41 |
| 409a | −1.18 | 0.34 | −0.78 | 0.38 | −0.40 | 1.32 | 1928a | 4.38 | 0.63 | 4.88 | 0.35 | −0.50 | 1.41 |
| 2120a | 1.36 | 0.41 | 1.76 | 0.41 | −0.40 | 1.32 | 597c | −1.06 | 0.49 | −0.56 | 0.28 | −0.50 | 1.41 |
| 1405c | 3.41 | 0.34 | 3.81 | 0.16 | −0.41 | 1.32 | 810a | −2.11 | 0.30 | −1.61 | 0.28 | −0.50 | 1.42 |
| 1765a | −1.60 | 0.28 | −1.19 | 0.28 | −0.41 | 1.33 | 1505c | 1.43 | 0.63 | 1.93 | 0.30 | −0.50 | 1.42 |
| 638b | −1.51 | 0.31 | −1.11 | 0.38 | −0.41 | 1.33 | 1941e | −1.88 | 0.28 | −1.38 | 0.54 | −0.51 | 1.42 |
| 329d | −2.04 | 0.47 | −1.63 | 0.26 | −0.41 | 1.33 | 742a | −2.26 | 0.51 | −1.75 | 0.26 | −0.51 | 1.42 |
| 1853a | 1.27 | 0.40 | 1.68 | 0.44 | −0.41 | 1.33 | 1993b | −1.33 | 0.38 | −0.82 | 0.34 | −0.51 | 1.42 |
| 2247a | −0.56 | 0.44 | −0.15 | 0.32 | −0.41 | 1.33 | 1299c | −2.39 | 0.42 | −1.88 | 0.40 | −0.51 | 1.42 |
| 166a | −0.97 | 0.34 | −0.56 | 0.25 | −0.41 | 1.33 | 1960a | −1.43 | 0.54 | −0.91 | 0.42 | −0.51 | 1.43 |
| 1746a | 1.41 | 0.43 | 1.83 | 0.31 | −0.41 | 1.33 | 1191a | 0.47 | 0.53 | 0.99 | 0.35 | −0.52 | 1.43 |
| 1797a | −1.79 | 0.25 | −1.38 | 0.30 | −0.42 | 1.33 | 2147a | −1.63 | 0.41 | −1.11 | 0.33 | −0.52 | 1.43 |
| 1729a | 3.95 | 0.37 | 4.37 | 0.23 | −0.42 | 1.34 | 562a | −2.16 | 0.44 | −1.64 | 0.27 | −0.52 | 1.43 |
| 1857c | −0.91 | 0.16 | −0.49 | 0.20 | −0.42 | 1.34 | 1678a | 6.05 | 0.47 | 6.57 | 0.26 | −0.52 | 1.44 |
| 1081a | −1.83 | 0.20 | −1.41 | 0.38 | −0.42 | 1.34 | 2223a | 5.99 | 0.52 | 6.52 | 0.26 | −0.52 | 1.44 |
| 2002c | −0.35 | 0.35 | 0.08 | 0.37 | −0.42 | 1.34 | 2099a | −1.06 | 0.44 | −0.53 | 0.43 | −0.52 | 1.44 |
| 785b | 0.98 | 0.41 | 1.40 | 0.42 | −0.42 | 1.34 | 342a | −1.81 | 0.48 | −1.28 | 0.41 | −0.52 | 1.44 |
| 1092b | −1.84 | 0.32 | −1.41 | 0.41 | −0.42 | 1.34 | 56a | 3.79 | 0.23 | 4.32 | 0.38 | −0.53 | 1.44 |
| 1784a | −2.32 | 0.38 | −1.89 | 0.35 | −0.43 | 1.34 | 1347b | −2.05 | 0.45 | −1.52 | 0.51 | −0.53 | 1.45 |
| 523a | −1.36 | 0.28 | −0.93 | 0.32 | −0.43 | 1.34 | 738b | −1.75 | 0.52 | −1.22 | 0.45 | −0.54 | 1.45 |
| 2172c | −2.54 | 0.17 | −2.11 | 0.11 | −0.43 | 1.35 | 1744a | 0.72 | 0.61 | 1.26 | 0.23 | −0.54 | 1.45 |
| 58a | −0.09 | 0.22 | 0.34 | 0.24 | −0.43 | 1.35 | 1814c | −1.03 | 0.40 | −0.49 | 0.37 | −0.54 | 1.45 |
| 411a | −1.73 | 0.44 | −1.30 | 0.28 | −0.43 | 1.35 | 1918a | −1.56 | 0.23 | −1.02 | 0.65 | −0.54 | 1.45 |
| 1511b | −2.18 | 0.35 | −1.75 | 0.41 | −0.43 | 1.35 | 129b | 0.47 | 0.26 | 1.01 | 0.26 | −0.54 | 1.45 |
| 1812b | −2.11 | 0.23 | −1.68 | 0.25 | −0.43 | 1.35 | 1924a | −0.46 | 0.34 | 0.08 | 0.41 | −0.54 | 1.45 |
| 1885c | −1.53 | 0.35 | −1.09 | 0.45 | −0.43 | 1.35 | 1060a | −1.90 | 0.48 | −1.36 | 0.37 | −0.54 | 1.45 |
| 1619a | −1.58 | 0.41 | −1.14 | 0.40 | −0.43 | 1.35 | 557b | −1.56 | 0.24 | −1.02 | 0.39 | −0.54 | 1.45 |
| 2344a | −1.74 | 0.27 | −1.30 | 0.51 | −0.43 | 1.35 | 1254a | −0.48 | 0.46 | 0.06 | 0.28 | −0.54 | 1.46 |
| 244a | −1.91 | 0.01 | −1.47 | 0.12 | −0.44 | 1.35 | 1292c | −0.94 | 0.32 | −0.40 | 0.47 | −0.54 | 1.46 |
| 70d | −1.65 | 0.30 | −1.21 | 0.34 | −0.44 | 1.36 | 2221c | −0.01 | 0.25 | 0.53 | 0.33 | −0.54 | 1.46 |
| 1477a | 2.42 | 0.56 | 2.86 | 0.31 | −0.44 | 1.36 | 490c | 4.71 | 0.34 | 5.26 | 0.42 | −0.54 | 1.46 |
| 1472a | 0.07 | 0.40 | 0.51 | 0.23 | −0.44 | 1.36 | 907a | −2.23 | 0.20 | −1.68 | 0.29 | −0.55 | 1.47 |
| 452a | −0.80 | 0.33 | −0.36 | 0.21 | −0.45 | 1.36 | 1224b | −1.32 | 0.59 | −0.76 | 0.15 | −0.56 | 1.47 |
| 360a | −2.11 | 0.42 | −1.66 | 0.22 | −0.45 | 1.36 | 469b | −0.61 | 0.31 | −0.05 | 0.29 | −0.56 | 1.47 |
| 1481c | −1.53 | 0.19 | −1.09 | 0.32 | −0.45 | 1.36 | 713a | −1.30 | 0.34 | −0.74 | 0.25 | −0.56 | 1.47 |
| 568a | 4.36 | 0.31 | 4.80 | 0.42 | −0.45 | 1.36 | 861c | −2.49 | 0.52 | −1.93 | 0.36 | −0.56 | 1.47 |
| 1940e | −0.44 | 0.30 | 0.01 | 0.20 | −0.45 | 1.36 | 1372a | 1.49 | 0.32 | 2.05 | 0.30 | −0.56 | 1.47 |
| 1109a | −2.20 | 0.47 | −1.75 | 0.18 | −0.45 | 1.37 | 482a | −1.55 | 0.25 | −0.99 | 0.39 | −0.56 | 1.48 |
| 1930a | −2.00 | 0.27 | −1.54 | 0.37 | −0.45 | 1.37 | 1098a | −2.29 | 0.30 | −1.72 | 0.31 | −0.56 | 1.48 |
| 1282b | −1.50 | 0.47 | −1.04 | 0.35 | −0.46 | 1.37 | 1785a | −2.19 | 0.09 | −1.63 | 0.27 | −0.56 | 1.48 |
| 739a | −0.46 | 0.27 | 0.00 | 0.15 | −0.46 | 1.37 | 1624b | −0.95 | 0.39 | −0.38 | 0.36 | −0.57 | 1.48 |
| 1276a | −1.63 | 0.43 | −1.17 | 0.51 | −0.46 | 1.38 | 1441d | −1.09 | 0.29 | −0.52 | 0.50 | −0.57 | 1.48 |
| 1728a | −0.95 | 0.47 | −0.49 | 0.26 | −0.46 | 1.38 | 553b | −0.76 | 0.16 | −0.19 | 0.27 | −0.57 | 1.48 |
| 1923b | −1.83 | 0.20 | −1.37 | 0.36 | −0.46 | 1.38 | 2033a | −2.11 | 0.38 | −1.54 | 0.43 | −0.57 | 1.49 |
| 2020b | −2.44 | 0.43 | −1.97 | 0.28 | −0.46 | 1.38 | 2179a | −2.12 | 0.29 | −1.55 | 0.46 | −0.57 | 1.49 |

TABLE 3-continued

| Gene ID | OA AVG | STD | Normal AVG | STD | DIF(OA-N) | Fold |
|---|---|---|---|---|---|---|
| 1349b | −2.15 | 0.62 | −1.58 | 0.13 | −0.57 | 1.49 |
| 1257b | −0.76 | 0.22 | −0.18 | 0.34 | −0.58 | 1.49 |
| 1506d | −1.45 | 0.32 | −0.88 | 0.36 | −0.58 | 1.49 |
| 1939c | −2.37 | 0.07 | −1.79 | 0.36 | −0.58 | 1.49 |
| 2007a | −1.93 | 0.29 | −1.35 | 0.20 | −0.58 | 1.49 |
| 715a | −2.15 | 0.46 | −1.57 | 0.38 | −0.58 | 1.50 |
| 1621a | −1.42 | 0.26 | −0.84 | 0.55 | −0.58 | 1.50 |
| 13a | −0.25 | 0.52 | 0.33 | 0.24 | −0.58 | 1.50 |
| 1288a | −1.12 | 0.25 | −0.53 | 0.36 | −0.58 | 1.50 |
| 379a | 3.55 | 0.61 | 4.14 | 0.46 | −0.59 | 1.50 |
| 1949a | −1.40 | 0.25 | −0.82 | 0.50 | −0.59 | 1.50 |
| 142.2c | 1.04 | 0.28 | 1.63 | 0.26 | −0.59 | 1.50 |
| 1054a | −0.73 | 0.26 | −0.14 | 0.31 | −0.59 | 1.50 |
| 570b | 0.13 | 0.60 | 0.72 | 0.27 | −0.59 | 1.50 |
| 1504d | 0.69 | 0.55 | 1.28 | 0.39 | −0.59 | 1.51 |
| 441a | −2.05 | 0.43 | −1.46 | 0.38 | −0.59 | 1.51 |
| 1943a | −1.74 | 0.31 | −1.14 | 0.67 | −0.59 | 1.51 |
| 1033c | −2.47 | 0.52 | −1.88 | 0.29 | −0.59 | 1.51 |
| 1404c | 2.76 | 0.43 | 3.35 | 0.29 | −0.59 | 1.51 |
| 8a | −0.51 | 0.51 | 0.08 | 0.30 | −0.60 | 1.51 |
| 46a | −0.07 | 0.54 | 0.52 | 0.34 | −0.60 | 1.51 |
| 1758a | 1.42 | 0.63 | 2.02 | 0.23 | −0.60 | 1.51 |
| 1985a | −1.92 | 0.23 | −1.33 | 0.50 | −0.60 | 1.51 |
| 326e | −0.12 | 0.25 | 0.48 | 0.24 | −0.60 | 1.51 |
| 85.1c | −0.04 | 0.40 | 0.56 | 0.22 | −0.60 | 1.51 |
| 1675a | −1.75 | 0.14 | −1.15 | 0.40 | −0.60 | 1.52 |
| 1772a | 0.78 | 0.51 | 1.38 | 0.60 | −0.60 | 1.52 |
| 1707c | −2.25 | 0.71 | −1.64 | 0.30 | −0.60 | 1.52 |
| 1474a | −2.38 | 0.36 | −1.78 | 0.42 | −0.60 | 1.52 |
| 574a | 0.54 | 0.26 | 1.14 | 0.47 | −0.61 | 1.52 |
| 1920a | −1.58 | 0.40 | −0.97 | 0.74 | −0.61 | 1.52 |
| 34a | −1.29 | 0.34 | −0.68 | 0.70 | −0.61 | 1.53 |
| 2205a | −1.01 | 0.49 | −0.40 | 0.59 | −0.61 | 1.53 |
| 1712a | 2.61 | 0.63 | 3.22 | 0.60 | −0.61 | 1.53 |
| 1010a | −2.60 | 0.42 | −1.99 | 0.31 | −0.61 | 1.53 |
| 1382d | −1.71 | 0.09 | −1.10 | 0.71 | −0.61 | 1.53 |
| 269b | −2.46 | 0.29 | −1.85 | 0.41 | −0.61 | 1.53 |
| 2159b | −2.29 | 0.29 | −1.67 | 0.44 | −0.62 | 1.53 |
| 1972a | −1.73 | 0.43 | −1.11 | 0.61 | −0.62 | 1.53 |
| 1298a | −1.70 | 0.39 | −1.08 | 0.55 | −0.62 | 1.53 |
| 2108b | 0.49 | 0.54 | 1.10 | 0.29 | −0.62 | 1.54 |
| 567b | −0.45 | 0.57 | 0.17 | 0.35 | −0.62 | 1.54 |
| 45.1b | 4.48 | 0.51 | 5.11 | 0.29 | −0.62 | 1.54 |
| 949c | −1.76 | 0.39 | −1.14 | 0.54 | −0.62 | 1.54 |
| 1545b | −1.84 | 0.48 | −1.22 | 0.50 | −0.63 | 1.54 |
| 2173a | 2.84 | 0.40 | 3.47 | 0.49 | −0.63 | 1.55 |
| 1676a | −1.90 | 0.07 | −1.27 | 0.47 | −0.63 | 1.55 |
| 581a | −1.77 | 0.16 | −1.14 | 0.25 | −0.63 | 1.55 |
| 472a | 4.26 | 0.74 | 4.89 | 0.42 | −0.63 | 1.55 |
| 1695a | 0.22 | 0.30 | 0.85 | 0.59 | −0.63 | 1.55 |
| 1414b | −0.28 | 0.42 | 0.35 | 0.39 | −0.64 | 1.55 |
| 151b | 0.13 | 0.48 | 0.77 | 0.28 | −0.64 | 1.55 |
| 112d | 0.04 | 0.49 | 0.68 | 0.40 | −0.64 | 1.56 |
| 461a | −1.37 | 0.49 | −0.73 | 0.24 | −0.64 | 1.56 |
| 1557a | −1.79 | 0.28 | −1.15 | 0.76 | −0.64 | 1.56 |
| 1615b | −1.61 | 0.56 | −0.97 | 0.34 | −0.64 | 1.56 |
| 489c | 1.81 | 0.65 | 2.46 | 0.29 | −0.64 | 1.56 |
| 310h | −1.41 | 0.50 | −0.76 | 0.25 | −0.64 | 1.56 |
| 297a | −1.13 | 0.38 | −0.48 | 0.25 | −0.64 | 1.56 |
| 1495a | −1.30 | 0.64 | −0.66 | 0.46 | −0.64 | 1.56 |
| 1801b | −0.24 | 0.28 | 0.41 | 0.38 | −0.65 | 1.56 |
| 23a | −1.60 | 0.45 | −0.96 | 0.22 | −0.65 | 1.56 |
| 1739a | −0.50 | 0.43 | 0.14 | 0.36 | −0.65 | 1.57 |
| 170a | 1.94 | 0.28 | 2.59 | 0.22 | −0.65 | 1.57 |
| 1955a | −1.57 | 0.30 | −0.93 | 0.52 | −0.65 | 1.57 |
| 1302a | −2.16 | 0.80 | −1.51 | 0.42 | −0.65 | 1.57 |
| 2088a | −0.75 | 0.46 | −0.10 | 0.29 | −0.65 | 1.57 |
| 18a | 0.01 | 0.67 | 0.66 | 0.39 | −0.65 | 1.57 |
| 182a | −1.80 | 0.28 | −1.15 | 0.55 | −0.65 | 1.57 |
| 2243b | −2.44 | 0.24 | −1.78 | 0.30 | −0.65 | 1.57 |
| 1440a | 1.14 | 0.42 | 1.79 | 0.36 | −0.65 | 1.57 |
| 2351c | −1.39 | 0.37 | −0.74 | 0.32 | −0.65 | 1.57 |
| 1415b | −0.73 | 0.33 | −0.07 | 0.32 | −0.66 | 1.58 |
| 2074b | −1.62 | 0.48 | −0.96 | 0.38 | −0.66 | 1.58 |
| 2250a | −2.15 | 0.21 | −1.49 | 0.39 | −0.66 | 1.58 |
| 1740a | −1.62 | 0.49 | −0.96 | 0.36 | −0.66 | 1.58 |
| 81a | 0.76 | 0.18 | 1.42 | 0.31 | −0.66 | 1.58 |
| 1248b | 0.18 | 0.52 | 0.85 | 0.18 | −0.67 | 1.59 |
| 82b | 0.44 | 0.58 | 1.10 | 0.26 | −0.67 | 1.59 |
| 991b | −1.16 | 0.56 | −0.50 | 0.70 | −0.67 | 1.59 |
| 1513b | −2.06 | 0.40 | −1.39 | 0.59 | −0.67 | 1.59 |
| 992a | −1.22 | 0.54 | −0.55 | 0.71 | −0.67 | 1.59 |
| 1147a | −1.35 | 0.32 | −0.68 | 0.29 | −0.67 | 1.60 |
| 12a | −1.59 | 0.21 | −0.92 | 0.39 | −0.67 | 1.60 |
| 2201a | −1.89 | 0.24 | −1.21 | 0.27 | −0.68 | 1.60 |
| 1032d | −0.81 | 0.78 | −0.12 | 0.27 | −0.69 | 1.61 |
| 1373a | −2.37 | 0.22 | −1.68 | 0.46 | −0.69 | 1.61 |
| 2266b | −1.26 | 0.33 | −0.57 | 0.27 | −0.69 | 1.61 |
| 795a | −1.16 | 0.32 | −0.47 | 0.19 | −0.69 | 1.61 |
| 206a | −1.93 | 0.37 | −1.25 | 0.52 | −0.69 | 1.61 |
| 1400a | 1.27 | 0.78 | 1.96 | 0.47 | −0.69 | 1.61 |
| 327f | −0.25 | 0.63 | 0.44 | 0.23 | −0.69 | 1.61 |
| 212a | −1.81 | 0.33 | −1.12 | 0.27 | −0.69 | 1.61 |
| 2083e | −1.73 | 0.39 | −1.04 | 0.28 | −0.69 | 1.61 |
| 555b | 0.58 | 0.33 | 1.28 | 0.16 | −0.69 | 1.62 |
| 1296a | −2.22 | 0.41 | −1.53 | 0.34 | −0.69 | 1.62 |
| 226a | −2.32 | 0.72 | −1.63 | 0.44 | −0.69 | 1.62 |
| 272d | −2.17 | 0.22 | −1.48 | 0.29 | −0.69 | 1.62 |
| 1709a | −2.13 | 0.40 | −1.43 | 0.34 | −0.70 | 1.62 |
| 1945a | 4.78 | 0.43 | 5.47 | 0.28 | −0.70 | 1.62 |
| 1631d | 2.12 | 0.58 | 2.82 | 0.28 | −0.70 | 1.62 |
| 1354a | −2.29 | 0.66 | −1.59 | 0.38 | −0.70 | 1.62 |
| 24a | −1.08 | 0.39 | −0.38 | 0.35 | −0.70 | 1.63 |
| 1284a | −0.15 | 0.44 | 0.55 | 0.25 | −0.71 | 1.63 |
| 184a | −1.80 | 0.27 | −1.09 | 0.35 | −0.71 | 1.63 |
| 936b | 1.54 | 0.58 | 2.25 | 0.17 | −0.71 | 1.63 |
| 1a | 4.14 | 0.55 | 4.85 | 0.50 | −0.71 | 1.63 |
| 1677b | 5.86 | 0.55 | 6.57 | 0.26 | −0.71 | 1.64 |
| 747a | −1.04 | 0.62 | −0.33 | 0.21 | −0.71 | 1.64 |
| 737a | 0.67 | 0.46 | 1.38 | 0.48 | −0.71 | 1.64 |
| 1953a | −1.46 | 0.35 | −0.74 | 0.75 | −0.72 | 1.64 |
| 794a | −0.98 | 0.85 | −0.26 | 0.46 | −0.72 | 1.65 |
| 2166a | −1.84 | 0.39 | −1.12 | 0.33 | −0.73 | 1.65 |
| 1604a | −2.12 | 0.49 | −1.39 | 0.36 | −0.73 | 1.66 |
| 479c | −1.62 | 0.45 | −0.89 | 0.24 | −0.73 | 1.66 |
| 1245b | −2.05 | 0.38 | −1.32 | 0.56 | −0.73 | 1.66 |
| 2040d | −2.46 | 0.37 | −1.73 | 0.23 | −0.73 | 1.66 |
| 1502a | −1.69 | 0.42 | −0.95 | 0.38 | −0.74 | 1.67 |
| 72a | −0.51 | 0.39 | 0.24 | 0.35 | −0.74 | 1.68 |
| 1917f | −1.03 | 0.41 | −0.28 | 0.44 | −0.75 | 1.69 |
| 1650a | −1.85 | 0.41 | −1.09 | 0.40 | −0.76 | 1.69 |
| 192a | −1.83 | 0.41 | −1.07 | 0.79 | −0.76 | 1.69 |
| 1620a | −1.99 | 0.27 | −1.23 | 0.43 | −0.76 | 1.69 |
| 1951a | −1.81 | 0.32 | −1.05 | 0.69 | −0.76 | 1.70 |
| 1398a | −2.82 | 0.45 | −2.05 | 0.43 | −0.77 | 1.70 |
| 2355c | −1.79 | 0.48 | −1.02 | 0.30 | −0.77 | 1.70 |
| 1394b | 1.65 | 0.77 | 2.42 | 0.24 | −0.77 | 1.71 |
| 1651a | −2.01 | 0.24 | −1.24 | 0.66 | −0.77 | 1.71 |
| 2071a | −2.70 | 0.03 | −1.93 | 0.28 | −0.78 | 1.71 |
| 340a | −2.01 | 0.24 | −1.23 | 0.38 | −0.78 | 1.72 |
| 368b | −0.08 | 0.51 | 0.70 | 0.26 | −0.78 | 1.72 |
| 736a | 2.45 | 0.61 | 3.24 | 0.54 | −0.79 | 1.73 |
| 64.2a | 1.87 | 0.88 | 2.66 | 0.56 | −0.79 | 1.73 |
| 17a | 0.06 | 0.68 | 0.86 | 0.32 | −0.80 | 1.74 |
| 1475a | −1.53 | 0.33 | −0.73 | 0.39 | −0.80 | 1.74 |
| 2161c | −1.79 | 0.44 | −0.99 | 0.70 | −0.80 | 1.74 |
| 143.2c | 1.35 | 0.33 | 2.16 | 0.23 | −0.81 | 1.75 |
| 1540a | −1.64 | 0.43 | −0.83 | 0.57 | −0.81 | 1.76 |
| 1521b | −1.05 | 0.59 | −0.23 | 0.15 | −0.82 | 1.76 |
| 2156c | −2.35 | 0.36 | −1.53 | 0.39 | −0.82 | 1.76 |
| 2035d | 0.44 | 0.71 | 1.26 | 0.43 | −0.82 | 1.77 |
| 1618b | 0.76 | 0.88 | 1.59 | 0.38 | −0.82 | 1.77 |
| 1516a | −2.38 | 0.36 | −1.55 | 0.45 | −0.83 | 1.78 |
| 1803a | −1.30 | 0.55 | −0.46 | 0.85 | −0.83 | 1.78 |
| 1593b | −2.07 | 0.66 | −1.23 | 0.31 | −0.84 | 1.79 |
| 1919a | −1.03 | 0.43 | −0.19 | 0.48 | −0.84 | 1.79 |
| 1648a | −2.08 | 0.43 | −1.24 | 0.56 | −0.84 | 1.79 |
| 2109a | 3.09 | 0.81 | 3.94 | 0.81 | −0.84 | 1.79 |
| 1241a | −0.64 | 0.38 | 0.22 | 0.80 | −0.86 | 1.82 |
| 392a | 0.29 | 0.94 | 1.16 | 0.35 | −0.86 | 1.82 |
| 1713a | −2.09 | 0.40 | −1.23 | 0.42 | −0.86 | 1.82 |
| 144.2a | 0.63 | 0.27 | 1.50 | 0.27 | −0.86 | 1.82 |
| 2255a | −1.13 | 0.35 | −0.26 | 0.46 | −0.87 | 1.83 |
| 1533a | −2.04 | 0.70 | −1.17 | 0.37 | −0.87 | 1.83 |

TABLE 3-continued

| Gene ID | OA AVG | STD | Normal AVG | STD | DIF(OA-N) | Fold |
|---|---|---|---|---|---|---|
| 690a | −0.08 | 0.56 | 0.79 | 0.19 | −0.87 | 1.83 |
| 1317a | −2.69 | 0.92 | −1.82 | 0.61 | −0.88 | 1.83 |
| 2163a | −1.44 | 0.74 | −0.56 | 0.38 | −0.88 | 1.84 |
| 979a | 1.91 | 0.69 | 2.78 | 0.52 | −0.88 | 1.84 |
| 1747a | −2.25 | 0.79 | −1.37 | 0.41 | −0.88 | 1.84 |
| 507a | −0.37 | 0.46 | 0.51 | 0.81 | −0.88 | 1.84 |
| 890a | −0.61 | 0.58 | 0.28 | 0.39 | −0.88 | 1.85 |
| 1137b | −0.71 | 1.21 | 0.18 | 0.36 | −0.89 | 1.85 |
| 395a | −2.00 | 0.46 | −1.11 | 0.29 | −0.89 | 1.85 |
| 51a | −0.61 | 0.76 | 0.28 | 0.60 | −0.89 | 1.85 |
| 1309b | −2.56 | 0.05 | −1.66 | 0.23 | −0.90 | 1.86 |
| 1462a | −0.23 | 0.28 | 0.68 | 0.39 | −0.92 | 1.89 |
| 1708a | −1.09 | 0.57 | −0.17 | 0.85 | −0.92 | 1.89 |
| 1086c | −1.08 | 0.45 | −0.16 | 0.74 | −0.92 | 1.89 |
| 1313a | −2.71 | 0.38 | −1.78 | 0.33 | −0.93 | 1.91 |
| 1439b | −0.90 | 0.30 | 0.04 | 0.36 | −0.94 | 1.91 |
| 153b | −0.48 | 0.31 | 0.46 | 0.95 | −0.94 | 1.92 |
| 1790a | −2.28 | 0.33 | −1.33 | 0.54 | −0.95 | 1.93 |
| 961a | −0.73 | 0.63 | 0.22 | 0.43 | −0.95 | 1.93 |
| 493a | 0.99 | 0.89 | 1.94 | 0.28 | −0.96 | 1.94 |
| 1463a | −0.08 | 0.21 | 0.88 | 0.17 | −0.96 | 1.94 |
| 172a | 2.00 | 0.43 | 2.97 | 0.35 | −0.97 | 1.96 |
| 1454d | −1.78 | 0.39 | −0.80 | 0.21 | −0.97 | 1.96 |
| 1143d | −1.02 | 0.47 | −0.05 | 0.52 | −0.98 | 1.97 |
| 862c | −1.96 | 1.22 | −0.98 | 0.56 | −0.98 | 1.97 |
| 766b | −1.85 | 0.31 | −0.86 | 0.50 | −0.99 | 1.99 |
| 1412b | 1.90 | 0.29 | 2.89 | 0.49 | −0.99 | 1.99 |
| 1423b | 3.55 | 0.77 | 4.54 | 0.20 | −0.99 | 1.99 |
| 850a | −0.14 | 0.42 | 0.87 | 0.59 | −1.01 | 2.02 |
| 148a | −0.73 | 0.40 | 0.32 | 0.27 | −1.05 | 2.07 |
| 1696a | 3.70 | 0.51 | 4.75 | 0.31 | −1.05 | 2.07 |
| 1396b | −2.51 | 0.36 | −1.45 | 0.49 | −1.06 | 2.08 |
| 2141a | 1.46 | 0.40 | 2.53 | 0.64 | −1.07 | 2.10 |
| 1503c | −0.13 | 0.75 | 0.95 | 0.30 | −1.08 | 2.11 |
| 639a | −1.04 | 0.62 | 0.04 | 0.50 | −1.08 | 2.12 |
| 1682a | −0.59 | 0.32 | 0.50 | 0.38 | −1.09 | 2.13 |
| 2153a | −0.83 | 0.49 | 0.26 | 0.41 | −1.09 | 2.13 |
| 2241a | −0.24 | 0.39 | 0.86 | 0.48 | −1.10 | 2.15 |
| 2263b | −1.18 | 0.52 | −0.08 | 0.42 | −1.10 | 2.15 |
| 1438a | 3.02 | 0.39 | 4.17 | 0.43 | −1.15 | 2.22 |
| 2059b | −1.36 | 0.47 | −0.13 | 0.49 | −1.22 | 2.34 |
| 1646a | 1.35 | 0.79 | 2.58 | 0.51 | −1.23 | 2.35 |
| 851d | −1.81 | 0.47 | −0.58 | 0.63 | −1.23 | 2.35 |
| 465b | −1.16 | 0.37 | 0.08 | 0.68 | −1.25 | 2.37 |
| 990a | 2.62 | 0.67 | 3.87 | 0.96 | −1.25 | 2.38 |
| 1488b | 0.21 | 0.78 | 1.46 | 0.66 | −1.25 | 2.38 |
| 1452a | 2.09 | 0.61 | 3.35 | 0.28 | −1.26 | 2.40 |
| 1270a | −1.47 | 0.36 | −0.19 | 0.54 | −1.28 | 2.43 |
| 2142a | 0.23 | 0.57 | 1.52 | 1.18 | −1.29 | 2.45 |
| 1371a | −3.40 | 1.22 | −2.10 | 0.45 | −1.30 | 2.46 |
| 945a | 0.76 | 0.68 | 2.06 | 0.30 | −1.30 | 2.47 |
| 2117b | 2.31 | 1.27 | 3.62 | 1.12 | −1.31 | 2.48 |
| 1367a | 0.92 | 0.83 | 2.25 | 0.65 | −1.33 | 2.51 |
| 1818a | 2.82 | 0.88 | 4.16 | 1.23 | −1.34 | 2.53 |
| 2198b | −0.03 | 0.54 | 1.32 | 1.21 | −1.34 | 2.54 |
| 1139a | 0.17 | 0.84 | 1.56 | 0.96 | −1.39 | 2.61 |
| 851a | −1.51 | 0.60 | −0.13 | 0.40 | −1.39 | 2.62 |
| 1138a | 2.33 | 0.75 | 3.73 | 0.88 | −1.41 | 2.65 |
| 1008a | 2.72 | 0.80 | 4.14 | 0.92 | −1.42 | 2.67 |
| 2113a | 2.70 | 1.23 | 4.13 | 1.11 | −1.43 | 2.69 |
| 552a | 0.19 | 0.55 | 1.65 | 0.46 | −1.46 | 2.74 |
| 2374a | 0.73 | 0.76 | 2.21 | 0.60 | −1.48 | 2.79 |
| 1532a | −0.57 | 0.70 | 0.94 | 0.70 | −1.51 | 2.85 |
| 2118a | −0.83 | 0.68 | 0.69 | 0.38 | −1.52 | 2.86 |
| 1366a | 1.60 | 0.90 | 3.14 | 0.82 | −1.53 | 2.90 |
| 1262b | −0.27 | 0.47 | 1.28 | 1.13 | −1.55 | 2.93 |
| 144.1c | 2.31 | 0.40 | 4.24 | 0.49 | −1.93 | 3.80 |
| 21a | 0.69 | 0.77 | 2.95 | 0.77 | −2.26 | 4.80 |
| 1246a | 0.28 | 0.85 | 3.33 | 1.44 | −3.05 | 8.29 |
| 1253a | −1.26 | 0.64 | 2.10 | 1.84 | −3.36 | 10.26 |
| 2224a | 0.08 | 0.44 | 3.48 | 0.64 | −3.40 | 10.57 |
| 1015d | −1.04 | 0.52 | 3.01 | 1.83 | −4.05 | 16.52 |
| 2252b | −0.50 | 0.58 | 3.90 | 1.80 | −4.39 | 21.00 |

TABLE 4

| Gene ID | OA AVG | STD | Normal AVG | STD | DIF(OA-N) | Fold |
|---|---|---|---|---|---|---|
| 1028c | 1.81 | 0.75 | 0.24 | 0.94 | 1.57 | 2.96 |
| 768a | 1.99 | 0.54 | 0.88 | 0.55 | 1.11 | 2.16 |
| 141c | 3.94 | 0.57 | 3.01 | 0.75 | 0.93 | 1.90 |
| 1548c | 5.49 | 0.41 | 4.79 | 0.46 | 0.69 | 1.62 |
| 1357a | −2.01 | 0.12 | −1.73 | 0.07 | −0.28 | 1.21 |
| 168c | 5.11 | 0.19 | 5.40 | 0.21 | −0.29 | 1.22 |
| 383d | −1.78 | 0.18 | −1.47 | 0.14 | −0.30 | 1.24 |
| 2127c | 0.08 | 0.23 | 0.48 | 0.31 | −0.39 | 1.31 |
| 530b | 1.39 | 0.21 | 1.78 | 0.23 | −0.40 | 1.32 |
| 1405c | 3.41 | 0.34 | 3.81 | 0.16 | −0.41 | 1.32 |
| 1765a | −1.60 | 0.28 | −1.19 | 0.28 | −0.41 | 1.33 |
| 166a | −0.97 | 0.34 | −0.56 | 0.25 | −0.41 | 1.33 |
| 1797a | −1.79 | 0.25 | −1.38 | 0.30 | −0.42 | 1.33 |
| 1729a | 3.95 | 0.37 | 4.37 | 0.23 | −0.42 | 1.34 |
| 1857c | −0.91 | 0.16 | −0.49 | 0.20 | −0.42 | 1.34 |
| 523a | −1.36 | 0.28 | −0.93 | 0.32 | −0.43 | 1.34 |
| 2172c | −2.54 | 0.17 | −2.11 | 0.11 | −0.43 | 1.35 |
| 58a | −0.09 | 0.22 | 0.34 | 0.24 | −0.43 | 1.35 |
| 244a | −1.91 | 0.01 | −1.47 | 0.12 | −0.44 | 1.35 |
| 70d | −1.65 | 0.30 | −1.21 | 0.34 | −0.44 | 1.36 |
| 1472a | 0.07 | 0.40 | 0.51 | 0.23 | −0.44 | 1.36 |
| 452a | −0.80 | 0.33 | −0.36 | 0.21 | −0.45 | 1.36 |
| 1481c | −1.53 | 0.19 | −1.09 | 0.32 | −0.45 | 1.36 |
| 1940e | −0.44 | 0.30 | 0.01 | 0.20 | −0.45 | 1.36 |
| 1930a | −2.00 | 0.27 | −1.54 | 0.37 | −0.45 | 1.37 |
| 739a | −0.46 | 0.27 | 0.00 | 0.15 | −0.46 | 1.37 |
| 1612a | −0.56 | 0.41 | −0.09 | 0.28 | −0.47 | 1.39 |
| 14a | −0.93 | 0.24 | −0.45 | 0.30 | −0.47 | 1.39 |
| 1727a | −1.68 | 0.31 | −1.20 | 0.27 | −0.48 | 1.39 |
| 1220b | 2.96 | 0.46 | 3.44 | 0.15 | −0.48 | 1.40 |
| 33a | 1.31 | 0.22 | 1.80 | 0.35 | −0.49 | 1.40 |
| 1146a | 0.55 | 0.33 | 1.04 | 0.34 | −0.50 | 1.41 |
| 1738b | −1.57 | 0.25 | −1.07 | 0.36 | −0.50 | 1.41 |
| 810a | −2.11 | 0.30 | −1.61 | 0.28 | −0.50 | 1.42 |
| 1993b | −1.33 | 0.38 | −0.82 | 0.34 | −0.51 | 1.42 |
| 2147a | −1.63 | 0.41 | −1.11 | 0.33 | −0.52 | 1.43 |
| 1678a | 6.05 | 0.47 | 6.57 | 0.26 | −0.52 | 1.44 |
| 56a | 3.79 | 0.23 | 4.32 | 0.38 | −0.53 | 1.44 |
| 1814c | −1.03 | 0.40 | −0.49 | 0.37 | −0.54 | 1.45 |
| 129b | 0.47 | 0.26 | 1.01 | 0.26 | −0.54 | 1.45 |
| 1924a | −0.46 | 0.34 | 0.08 | 0.41 | −0.54 | 1.45 |
| 557b | −1.56 | 0.24 | −1.02 | 0.39 | −0.54 | 1.45 |
| 1254a | −0.48 | 0.46 | 0.06 | 0.28 | −0.54 | 1.46 |
| 1292c | −0.94 | 0.32 | −0.40 | 0.47 | −0.54 | 1.46 |
| 2221c | −0.01 | 0.25 | 0.53 | 0.33 | −0.54 | 1.46 |
| 490c | 4.71 | 0.34 | 5.26 | 0.42 | −0.54 | 1.46 |
| 907a | −2.23 | 0.20 | −1.68 | 0.29 | −0.55 | 1.47 |
| 469d | −0.61 | 0.31 | −0.05 | 0.29 | −0.56 | 1.47 |
| 713a | −1.30 | 0.34 | −0.74 | 0.25 | −0.56 | 1.47 |
| 1372a | 1.49 | 0.32 | 2.05 | 0.30 | −0.56 | 1.47 |
| 482a | −1.55 | 0.25 | −0.99 | 0.39 | −0.56 | 1.48 |
| 1098a | −2.29 | 0.30 | −1.72 | 0.31 | −0.56 | 1.48 |
| 1785a | −2.19 | 0.09 | −1.63 | 0.27 | −0.56 | 1.48 |
| 1624b | −0.95 | 0.39 | −0.38 | 0.36 | −0.57 | 1.48 |
| 1441d | −1.09 | 0.29 | −0.52 | 0.50 | −0.57 | 1.48 |
| 553b | −0.76 | 0.16 | −0.19 | 0.27 | −0.57 | 1.48 |
| 2179a | −2.12 | 0.29 | −1.55 | 0.46 | −0.57 | 1.49 |
| 1257b | −0.76 | 0.22 | −0.18 | 0.34 | −0.58 | 1.49 |
| 1506d | −1.45 | 0.32 | −0.88 | 0.36 | −0.58 | 1.49 |
| 1939a | −2.37 | 0.07 | −1.79 | 0.36 | −0.58 | 1.49 |
| 2007a | −1.93 | 0.29 | −1.35 | 0.20 | −0.58 | 1.49 |
| 13a | −0.25 | 0.52 | 0.33 | 0.24 | −0.58 | 1.50 |
| 1288a | −1.12 | 0.25 | −0.53 | 0.36 | −0.58 | 1.50 |
| 1949a | −1.40 | 0.25 | −0.82 | 0.50 | −0.59 | 1.50 |
| 142.2c | 1.04 | 0.28 | 1.63 | 0.26 | −0.59 | 1.50 |
| 1054a | −0.73 | 0.26 | −0.14 | 0.31 | −0.59 | 1.50 |
| 1404c | 2.76 | 0.43 | 3.35 | 0.29 | −0.59 | 1.51 |
| 8a | −0.51 | 0.51 | 0.08 | 0.30 | −0.60 | 1.51 |
| 46a | −0.07 | 0.54 | 0.52 | 0.34 | −0.60 | 1.51 |
| 1985a | −1.92 | 0.23 | −1.33 | 0.50 | −0.60 | 1.51 |
| 326e | −0.12 | 0.25 | 0.48 | 0.24 | −0.60 | 1.51 |
| 85.1c | −0.04 | 0.40 | 0.56 | 0.22 | −0.60 | 1.51 |
| 1675a | −1.75 | 0.14 | −1.15 | 0.40 | −0.60 | 1.52 |
| 574a | 0.54 | 0.26 | 1.14 | 0.47 | −0.61 | 1.52 |
| 2159b | −2.29 | 0.29 | −1.67 | 0.44 | −0.62 | 1.53 |
| 2108b | 0.49 | 0.54 | 1.10 | 0.29 | −0.62 | 1.54 |
| 45.1b | 4.48 | 0.51 | 5.11 | 0.29 | −0.62 | 1.54 |

TABLE 4-continued

| Gene ID | OA AVG | STD | Normal AVG | STD | DIF(OA-N) | Fold |
|---|---|---|---|---|---|---|
| 2173a | 2.84 | 0.40 | 3.47 | 0.49 | −0.63 | 1.55 |
| 1676a | −1.90 | 0.07 | −1.27 | 0.47 | −0.63 | 1.55 |
| 581a | −1.77 | 0.16 | −1.14 | 0.25 | −0.63 | 1.55 |
| 1695a | 0.22 | 0.30 | 0.85 | 0.59 | −0.63 | 1.55 |
| 1414b | −0.28 | 0.42 | 0.35 | 0.39 | −0.64 | 1.55 |
| 151b | 0.13 | 0.48 | 0.77 | 0.28 | −0.64 | 1.55 |
| 112d | 0.04 | 0.49 | 0.68 | 0.40 | −0.64 | 1.56 |
| 461a | −1.37 | 0.49 | −0.73 | 0.24 | −0.64 | 1.56 |
| 1615b | −1.61 | 0.56 | −0.97 | 0.34 | −0.64 | 1.56 |
| 310h | −1.41 | 0.50 | −0.76 | 0.25 | −0.64 | 1.56 |
| 297a | −1.13 | 0.38 | −0.48 | 0.25 | −0.64 | 1.56 |
| 1801b | −0.24 | 0.28 | 0.41 | 0.38 | −0.65 | 1.56 |
| 23a | −1.60 | 0.45 | −0.96 | 0.22 | −0.65 | 1.56 |
| 1739a | −0.50 | 0.43 | 0.14 | 0.36 | −0.65 | 1.57 |
| 170a | 1.94 | 0.28 | 2.59 | 0.22 | −0.65 | 1.57 |
| 1955a | −1.57 | 0.30 | −0.93 | 0.52 | −0.65 | 1.57 |
| 2088a | −0.75 | 0.46 | −0.10 | 0.29 | −0.65 | 1.57 |
| 2243b | −2.44 | 0.24 | −1.78 | 0.30 | −0.65 | 1.57 |
| 1440a | 1.14 | 0.42 | 1.79 | 0.36 | −0.65 | 1.57 |
| 2351c | −1.39 | 0.37 | −0.74 | 0.32 | −0.65 | 1.57 |
| 1415b | −0.73 | 0.33 | −0.07 | 0.32 | −0.66 | 1.58 |
| 2074b | −1.62 | 0.48 | −0.96 | 0.38 | −0.66 | 1.58 |
| 2250a | −2.15 | 0.21 | −1.49 | 0.39 | −0.66 | 1.58 |
| 1740a | −1.62 | 0.49 | −0.96 | 0.36 | −0.66 | 1.58 |
| 81a | 0.76 | 0.18 | 1.42 | 0.31 | −0.66 | 1.58 |
| 1248b | 0.18 | 0.52 | 0.85 | 0.18 | −0.67 | 1.59 |
| 82b | 0.44 | 0.58 | 1.10 | 0.26 | −0.67 | 1.59 |
| 1147a | −1.35 | 0.32 | −0.68 | 0.29 | −0.67 | 1.60 |
| 12a | −1.59 | 0.21 | −0.92 | 0.39 | −0.67 | 1.60 |
| 2201a | −1.89 | 0.24 | −1.21 | 0.27 | −0.68 | 1.60 |
| 2266b | −1.26 | 0.33 | −0.57 | 0.27 | −0.69 | 1.61 |
| 795a | −1.16 | 0.32 | −0.47 | 0.19 | −0.69 | 1.61 |
| 206a | −1.93 | 0.37 | −1.25 | 0.52 | −0.69 | 1.61 |
| 327f | −0.25 | 0.63 | 0.44 | 0.23 | −0.69 | 1.61 |
| 212a | −1.81 | 0.33 | −1.12 | 0.27 | −0.69 | 1.61 |
| 2083e | −1.73 | 0.39 | −1.04 | 0.28 | −0.69 | 1.61 |
| 555b | 0.58 | 0.33 | 1.28 | 0.16 | −0.69 | 1.62 |
| 1296a | −2.22 | 0.41 | −1.53 | 0.34 | −0.69 | 1.62 |
| 272c | −2.17 | 0.22 | −1.48 | 0.29 | −0.69 | 1.62 |
| 1709a | −2.13 | 0.40 | −1.43 | 0.34 | −0.70 | 1.62 |
| 1945a | 4.78 | 0.43 | 5.47 | 0.28 | −0.70 | 1.62 |
| 1631d | 2.12 | 0.58 | 2.82 | 0.28 | −0.70 | 1.62 |
| 24a | −1.08 | 0.39 | −0.38 | 0.35 | −0.70 | 1.63 |
| 1284a | −0.15 | 0.44 | 0.55 | 0.25 | −0.71 | 1.63 |
| 184a | −1.80 | 0.27 | −1.09 | 0.35 | −0.71 | 1.63 |
| 936b | 1.54 | 0.58 | 2.25 | 0.17 | −0.71 | 1.63 |
| 1a | 4.14 | 0.55 | 4.85 | 0.50 | −0.71 | 1.63 |
| 1677b | 5.86 | 0.55 | 6.57 | 0.26 | −0.71 | 1.64 |
| 747a | −1.04 | 0.62 | −0.33 | 0.21 | −0.71 | 1.64 |
| 737a | 0.67 | 0.46 | 1.38 | 0.48 | −0.71 | 1.64 |
| 2166a | −1.84 | 0.39 | −1.12 | 0.33 | −0.73 | 1.65 |
| 479c | −1.62 | 0.45 | −0.89 | 0.24 | −0.73 | 1.66 |
| 2040d | −2.46 | 0.37 | −1.73 | 0.23 | −0.73 | 1.66 |
| 1502a | −1.69 | 0.42 | −0.95 | 0.38 | −0.74 | 1.67 |
| 72a | −0.51 | 0.39 | 0.24 | 0.35 | −0.74 | 1.68 |
| 1917f | −1.03 | 0.41 | −0.28 | 0.44 | −0.75 | 1.69 |
| 1650a | −1.85 | 0.41 | −1.09 | 0.40 | −0.76 | 1.69 |
| 1620a | −1.99 | 0.27 | −1.23 | 0.43 | −0.76 | 1.69 |
| 1951a | −1.81 | 0.32 | −1.05 | 0.69 | −0.76 | 1.70 |
| 2355c | −1.79 | 0.48 | −1.02 | 0.30 | −0.77 | 1.70 |
| 1394b | 1.65 | 0.77 | 2.42 | 0.24 | −0.77 | 1.71 |
| 2071a | −2.70 | 0.03 | −1.93 | 0.28 | −0.78 | 1.71 |
| 340a | −2.01 | 0.24 | −1.23 | 0.38 | −0.78 | 1.72 |
| 368b | −0.08 | 0.51 | 0.70 | 0.26 | −0.78 | 1.72 |
| 736a | 2.45 | 0.61 | 3.24 | 0.54 | −0.79 | 1.73 |
| 17a | 0.06 | 0.68 | 0.86 | 0.32 | −0.80 | 1.74 |
| 1475a | −1.53 | 0.33 | −0.73 | 0.39 | −0.80 | 1.74 |
| 143.2c | 1.35 | 0.33 | 2.16 | 0.23 | −0.81 | 1.75 |
| 1540a | −1.64 | 0.43 | −0.83 | 0.57 | −0.81 | 1.76 |
| 1521b | −1.05 | 0.59 | −0.23 | 0.15 | −0.82 | 1.76 |
| 2156c | −2.35 | 0.36 | −1.53 | 0.39 | −0.82 | 1.76 |
| 2035d | 0.44 | 0.71 | 1.26 | 0.43 | −0.82 | 1.77 |
| 1919a | −1.03 | 0.43 | −0.19 | 0.48 | −0.84 | 1.79 |
| 1648a | −2.08 | 0.43 | −1.24 | 0.56 | −0.84 | 1.79 |
| 1241a | −0.64 | 0.38 | 0.22 | 0.80 | −0.86 | 1.82 |
| 1713a | −2.09 | 0.40 | −1.23 | 0.42 | −0.86 | 1.82 |
| 144.2a | 0.63 | 0.27 | 1.50 | 0.27 | −0.86 | 1.82 |
| 2255a | −1.13 | 0.35 | −0.26 | 0.46 | −0.87 | 1.83 |
| 690a | −0.08 | 0.56 | 0.79 | 0.19 | −0.87 | 1.83 |
| 2163a | −1.44 | 0.74 | −0.56 | 0.38 | −0.88 | 1.84 |
| 979a | 1.91 | 0.69 | 2.78 | 0.52 | −0.88 | 1.84 |
| 1747a | −2.25 | 0.79 | −1.37 | 0.41 | −0.88 | 1.84 |
| 507a | −0.37 | 0.46 | 0.51 | 0.81 | −0.88 | 1.84 |
| 890a | −0.61 | 0.58 | 0.28 | 0.39 | −0.88 | 1.85 |
| 395a | −2.00 | 0.46 | −1.11 | 0.29 | −0.89 | 1.85 |
| 1309b | −2.56 | 0.05 | −1.66 | 0.23 | −0.90 | 1.86 |
| 1462a | −0.23 | 0.28 | 0.68 | 0.39 | −0.92 | 1.89 |
| 1086c | −1.08 | 0.45 | −0.16 | 0.74 | −0.92 | 1.89 |
| 1313a | −2.71 | 0.38 | −1.78 | 0.33 | −0.93 | 1.91 |
| 1439b | −0.90 | 0.30 | 0.04 | 0.36 | −0.94 | 1.91 |
| 153b | −0.48 | 0.31 | 0.46 | 0.95 | −0.94 | 1.92 |
| 1790a | −2.28 | 0.33 | −1.33 | 0.54 | −0.95 | 1.93 |
| 961a | −0.73 | 0.63 | 0.22 | 0.43 | −0.95 | 1.93 |
| 493a | 0.99 | 0.89 | 1.94 | 0.28 | −0.96 | 1.94 |
| 1463a | −0.08 | 0.21 | 0.88 | 0.17 | −0.96 | 1.94 |
| 172a | 2.00 | 0.43 | 2.97 | 0.35 | −0.97 | 1.96 |
| 1454d | −1.78 | 0.39 | −0.80 | 0.21 | −0.97 | 1.96 |
| 1143d | −1.02 | 0.47 | −0.05 | 0.52 | −0.98 | 1.97 |
| 766b | −1.85 | 0.31 | −0.86 | 0.50 | −0.99 | 1.99 |
| 1412b | 1.90 | 0.29 | 2.89 | 0.49 | −0.99 | 1.99 |
| 1423b | 3.55 | 0.77 | 4.54 | 0.20 | −0.99 | 1.99 |
| 850a | −0.14 | 0.42 | 0.87 | 0.59 | −1.01 | 2.02 |
| 148a | −0.73 | 0.40 | 0.32 | 0.27 | −1.05 | 2.07 |
| 1696a | 3.70 | 0.51 | 4.75 | 0.31 | −1.05 | 2.07 |
| 1396b | −2.51 | 0.36 | −1.45 | 0.49 | −1.06 | 2.08 |
| 2141a | 1.46 | 0.40 | 2.53 | 0.64 | −1.07 | 2.10 |
| 1503c | −0.13 | 0.75 | 0.95 | 0.30 | −1.08 | 2.11 |
| 639a | −1.04 | 0.62 | 0.04 | 0.50 | −1.08 | 2.12 |
| 1682a | −0.59 | 0.32 | 0.50 | 0.38 | −1.09 | 2.13 |
| 2153a | −0.83 | 0.49 | 0.26 | 0.41 | −1.09 | 2.13 |
| 2241a | −0.24 | 0.39 | 0.86 | 0.48 | −1.10 | 2.15 |
| 2263b | −1.18 | 0.52 | −0.08 | 0.42 | −1.10 | 2.15 |
| 1438a | 3.02 | 0.39 | 4.17 | 0.43 | −1.15 | 2.22 |
| 2059b | −1.36 | 0.47 | −0.13 | 0.49 | −1.22 | 2.34 |
| 1646a | 1.35 | 0.79 | 2.58 | 0.51 | −1.23 | 2.35 |
| 851d | −1.81 | 0.47 | −0.58 | 0.63 | −1.23 | 2.35 |
| 465b | −1.16 | 0.37 | 0.08 | 0.68 | −1.25 | 2.37 |
| 990a | 2.62 | 0.67 | 3.87 | 0.96 | −1.25 | 2.38 |
| 1488b | 0.21 | 0.78 | 1.46 | 0.66 | −1.25 | 2.38 |
| 1452a | 2.09 | 0.61 | 3.35 | 0.28 | −1.26 | 2.40 |
| 1270a | −1.47 | 0.36 | −0.19 | 0.54 | −1.28 | 2.43 |
| 2142a | 0.23 | 0.57 | 1.52 | 1.18 | −1.29 | 2.45 |
| 945a | 0.76 | 0.68 | 2.06 | 0.30 | −1.30 | 2.47 |
| 1367a | 0.92 | 0.83 | 2.25 | 0.65 | −1.33 | 2.51 |
| 2198b | −0.03 | 0.54 | 1.32 | 1.21 | −1.34 | 2.54 |
| 1139a | 0.17 | 0.84 | 1.56 | 0.96 | −1.39 | 2.61 |
| 1138a | 2.33 | 0.75 | 3.73 | 0.88 | −1.41 | 2.65 |
| 1008a | 2.72 | 0.80 | 4.14 | 0.92 | −1.42 | 2.67 |
| 552a | 0.19 | 0.55 | 1.65 | 0.46 | −1.46 | 2.74 |
| 2374a | 0.73 | 0.76 | 2.21 | 0.60 | −1.48 | 2.79 |
| 1532a | −0.57 | 0.70 | 0.94 | 0.70 | −1.51 | 2.85 |
| 2118a | −0.83 | 0.68 | 0.69 | 0.38 | −1.52 | 2.86 |
| 1366a | 1.60 | 0.90 | 3.14 | 0.82 | −1.53 | 2.90 |
| 1262b | −0.27 | 0.47 | 1.28 | 1.13 | −1.55 | 2.93 |
| 144.1c | 2.31 | 0.40 | 4.24 | 0.49 | −1.93 | 3.80 |
| 21a | 0.69 | 0.77 | 2.95 | 0.77 | −2.26 | 4.80 |
| 1246a | 0.28 | 0.85 | 3.33 | 1.44 | −3.05 | 8.29 |
| 1253a | −1.26 | 0.64 | 2.10 | 1.84 | −3.36 | 10.26 |
| 2224a | 0.08 | 0.44 | 3.48 | 0.64 | −3.40 | 10.57 |
| 1015d | −1.04 | 0.52 | 3.01 | 1.83 | −4.05 | 16.52 |
| 2252b | −0.50 | 0.58 | 3.90 | 1.80 | −4.39 | 21.00 |

The use of differential display to isolate gene transcripts has enabled the present inventors to develop a microarray chip enriched in transcripts involved in osteoarthritis. The use of this chip to analyze samples from canines with osteoarthritis (1) confirms the results from differential display and (2) enables further characterization of canine osteoarthritis at the molecular level. Transcripts analyzed by qPCR (discussed infra) have validated the differential expression analysis from the microarray.

EXAMPLE 5

Quantitative Polymerase Chain Reaction (qPCR)

Confirmation of changes in RNA transcripts was performed using quantitative PCR. Reverse transcriptase reactions were performed using Super Script™ II Reverse Transcriptase for RT-PCR (Invitrogen) according to the manufacture's directions. 1 g of RNA was added to 1.5 µL 10 mM dNTP's, 1.5 µL random hexamers and 0.6 µL Oligo dT primers and brought to a final volume of 15 uL. Samples were incubated at 68° C. for 10 minutes and then brought down to 4° C. for at least 1 minute using a GeneAmp PCR System 9700 (Applied Biosystems). A portion (0.25×) of the above reaction was removed and used as a minus RT reaction (Negative Control containing No Super Script II Reverse Transcriptase). Using the same Super Scrip™ II Reverse Transcriptase kit, a master mix containing 3 µL of 10×RT buffer, 6 µL of 25 mM $MgCl_2$, 3 µL 0.1M DTT and 1.5 µL RNAse Inhibitor was made. A portion (0.25×) was removed and 0.375 µL $H_2O$ was added for the minus RT samples. To the remainder of the Master Mix, 1.125 µL Super Scrip™ II Reverse Transcriptase was added for the positive RT reactions. All reactions were then incubated at 42° C. for 1 hour, boiled at 95° C. for 5 minutes, and the brought down to 4° C. using a GeneAmp PCR System 9700. The samples were then diluted 1 part RT reaction to 29 Parts $H_2O$ to create a stock of cDNA for experimentation.

Primers and 5' nuclease assay probes were designed based on selected sequences from the differential display using Primer Express™ v1.5 (Applied Biosystems Primer Express® Tutorial for Real Time Quantitative PCR Primer and Probe Design Tutorial). Minor groove Binding probes (ABI Custom Oligo Synthesis Factory) were ordered from ABI. All oligos were reconstituted with TE buffer pH=8.0 (Ambion) to 100 µM stock concentration, and then diluted with TE buffer to a 5 µM working stock concentration. Taq-Man® Universal PCR Master Mix (Applied Biosystems) was used for quantitative PCR reactions according to the manufacture's directions. Primer concentration was 300 µM each and Probe concentration was 200 µM (determined optimal from earlier experiments). 4 µl of RT and minus RT reactions were used for quantitative PCR reactions. All positive reactions were done in triplicate, and negative controls were performed singly. Standard qPCR conditions were used as described in the TaqMan® Universal Master Mix (Applied Biosystems, 50.0° C. for 2 minutes, 95.0° C. for 10 minutes, and 40-50 cycles of 95° C. for 15 seconds then 60° C. for 1 minute) at 0.5 volumes. Samples were run on an ABI Prism 7700 Sequence Detector using ABI Sequence Detector Program v1.7a.

All samples were run singularly against each primer/probe set to determine what standard curve should be used. Standard curves were generated using serial dilutions of liver RNA or RNA from experimental samples. Alternately, if the samples did not fall within either of the curve ranges, the sample with the lowest $C_T$ (cycle threshold) would be re-reverse transcribed and a 1:10 serial dilution would be used as the standard curve for that primer/probe set. Values were normalized to G3PDH (glyceraldehyde-3-phoshate dehydrogenase) levels as determined by quantitative PCR. Inductions were calculated from each of the lowest sample's normalized value. Error bars represent standard error of the means.

Table 5 shows the primers and probes used for the qPCR analysis.

TABLE 5

| I. Clone Target | SEQ ID NO: | Primers and Probes (5'-3') |
|---|---|---|
| K9 G3PDH-Fwd | 1567 | GTC ATC ATC TCT GCT CCT TCT GC |
| Rev | 1568 | TGA CAA TCT TGA GGG AGT TGT CA |
| Probe | 1569 | 6FAM-CTT CTC ATG GTT CAC GCC CAT CAC AAA-MGBNFQ |
| 11B-Fwd | 1570 | TTG ATA CTC CTA GTC TTG TCT ATT CAC TGA |
| Rev | 1571 | TCG AGT TTT TGC TCT TTG GAG AA |
| Probe | 1572 | 6FAM-TCA TTC AAC CCA GCA TTG AAC AAG GCT-MGBNFQ |
| 59A-Fwd | 1573 | AGC AGG TGT TCA TCC CAG AAT G |
| Rev | 1574 | GGG TGT GAC GCA CCA ACA G |
| Probe | 1575 | 6FAM-CCT ACA GCC AGG TGC AGT GTC ACA GC-MGBNFQ |
| 127B-Fwd | 1576 | GCA TCC CCG AGC CTC AT |
| Rev | 1577 | GGG TGC TAT ACA GTC CAG GTC AA |
| Probe | 1578 | 6FAM-TCT ATC TCC CCA GCT GCT TCC CCA C-MGBNFQ |
| 141C-Fwd | 1579 | AAG GAA GTC CAA TAA ATT CTT TGT TTG |
| Rev | 1580 | TGC CAG GAT TGT TGG TCT GTT |
| Probe | 1581 | 6FAM-CTC CTG CTG TTA CCC CAG TGA AGA GTG TTT T-MGBNFQ |
| 159A-Fwd | 1582 | CAG GCT GCC AAC GAA TGG |
| Rev | 1583 | AGA CCG GCT CTT GAG GAC AGA |
| Probe | 1584 | 6FAM-TGG CCT GCC TGA CAA GTA CTG AGC TTC-MGBNFQ |
| 768A-Fwd | 1585 | CCA TCT TTT CTC CCT CCT CAA CT |
| Rev | 1586 | GGT CTT CAG GTG ATG GTG GG |
| Probe | 1587 | 6FAM-TCT TCA GCG GGA CTC CCT CTT GGG-MGBNFQ |
| 794A-Fwd | 1588 | AGT TTG GCT CCC TAA GTA GAT CAC TT |
| Rev | 1589 | GAA TAC AGC TAC CAC CAA CTT TCA ATT |
| Probe | 1590 | 6FAM-CTA AAT GCT TTG GAT GAT TGT CCG CTT CTC A-MGBNFQ |
| 851D-Fwd | 1591 | TGA ACA TGC TAA CCT GCG TCT C |
| Rev | 1592 | GAC GTG TTT TCT CGG CTG GA |
| Probe | 1593 | 6FAM-CCC ACG TAG TCC GTG GGA GAC CC-MGBNFQ |
| 2252B-Fwd | 1594 | CAT GTT GGT TCT GAA AAG GTC TGA |
| Rev | 1595 | GGT GAG CCA AAA GCC ATA GCT |
| Probe | 1596 | 6FAM-CCT TTA CTC CGT GCA GAT CTA CTG CTC AGC-MGBNFQ |
| 2258A-Fwd | 1597 | TGT GTT TTG TTT GTT TTG CTT GTT T |
| Rev | 1598 | AGA AAG AAA AAA GGA AAG ATG AGT TCA |
| Probe | 1599 | 6FAM-CGC CCC CCA AAC CTT TTG TTC TCT C-MGBNFQ |
| 1678A-Fwd | 1600 | ACT ATT TCA TAC CCT CTC CCA CTA CAA |
| Rev | 1601 | CCC ACA AAT ACA ATT TAT ATT TAG CAG TGA |
| Probe | 1602 | 6FAM-TTT CCG TGC AGT TAC CTT TCA TTT TTA AAG CAA-MGBNFQ |
| 1466B-Fwd | 1603 | ACA AGA CAT CCT ACC GCT GGT T |
| Rev | 1604 | CAG CTC AGG ACC CTC GTA GAA |
| Probe | 1605 | 6FAM-CTG CAG CAT CGG CCC CAA GTG-MGBNFQ |
| 2141A-Fwd | 1606 | TGA GAT TCA ACA CTT CCC AGT CAA |
| Rev | 1607 | TGT CCC CAT GGT TAG GTG ACA |

TABLE 5-continued

| I. Clone Target | SEQ ID NO: | Primers and Probes (5'-3') |
|---|---|---|
| Probe | 1608 | 6FAM-TAT TTA CAT CAG GCA AAG CAG CAT CAG CAA-MGBNFQ |
| 2267A-Fwd | 1609 | AAA TAA CAA AAG GTG AAA CTT CTA TAC AAA TAT T |
| Rev | 1610 | AAG TTT GTA AGA CAC TTA AAC TCT TTC TGC |
| Probe | 1611 | 6FAM-CCA AAA ATT CTT TAC TCA GTC ACA CAA CAA ATG AGG-MGBNFQ |

EXAMPLE 6 qPCR Analysis of Canine OA Cartilage qPCR was performed as described, supra, on 6 osteoarthritic cartilage samples from clinically diagnosed canines undergoing total hip replacement and 8 normal cartilage samples. Results are shown in FIG. 2 (A-E).

EXAMPLE 7

Microarray Analysis of Treated OA Samples

A. In Vitro Chondrocyte Cell Culture

Canine cartilage was digested in a 37° C. shaking water bath using the following enzymes: trypsin (0.25%) for 25 minutes, hyaluronidase (150 U/ml) for 1 hour, and collagenase (0.78%) overnight. Digested cartilage was filtered to obtain chondrocytes. Dulbecco's Modified Eagle Medium (DMEM)+2.4% alginate (low melting)+ cells were dropped from a 10 cc syringe into calcium chloride (102 mM) to form "beads." Chondrocyte beads were cultured in DMEM/F12+P/S (100 U/mL penicillin and 100 µg/mL streptomycin)+10% Fetal Bovine Serum (FBS). Media was changed every other day. At the end of the treatment (see below), the chondrocyte beads were dissolved in sodium citrate (55 mM) and EDTA (30 mM). Suspensions were centrifuged at 1800 rpm for 10 minutes. Cells were washed with phosphate buffer and centrifuged again at 1800 rpm for 5 minutes. One mL lysis binding solution (Ambion® RNAqueous™) was added to the isolated canine chondrocyte pellet, mixed thoroughly and stored at −20° C. until RNA isolation could be performed.

B. RNA Isolation from Cell Culture

Samples were vortexed and homogenized using a Quiashredder (Qiagen) column according to manufacture's directions. The homogenized lysate was collected and 1 equal volume of 64% ethanol was added to it. This mixture was then applied to an RNAqueous™ filter cartridge, 700 uL at a time, and centrifuged for 1 minute at 10,000 rpm. The cartridge was washed using 700 uL wash solution #1 and 500 uL wash solution #2/3 with centrifugation at 10,000 rpm for 1 minute for each wash. The filter cartridge was dried by centrifugation (10,000 rpm) for 1 minute. RNA was eluted 3 times by centrifugation (as above) using 30 uL aliquots of 95-100° C. elution solution. The resulting RNA was DNAse-treated and quantitated as stated previously. Following RNA isolation, the RNA was prepared for microarray hybridization as stated previously.

C. Statistical Analysis of Cell Culture Microarray

Data were transformed to logarithm, base 2. Data were normalized using quantile normalization. After normalization, a concordance correlation was computed.

Differentially expressed genes were determined using a paired t test ($\alpha=0.05$) for the EPA vs. AA; EPAstim vs. AAstim; chondroitin sulfate and glucosamine 100 µg vs. control, 100 µg vs. 10 µg and 10 µg vs. control.

Differentially expressed genes were determined by first using ratios of AAstim vs. AA and EPAstim vs. EPA followed by a paired t test ($\alpha=0.05$) for the ratios of AAstim/AA and EPAstim/EPA.

Differentially expressed genes following a unidirectional trend for all glucosamine and chondroitin sulfate analyses were determined for each treatment pair where responses to the treatment resulted in increases or decreases, in the same direction, in all three samples.

Differentially expressed genes were determined using a Welch modified two-sample t test for both 1,25 D3 vs. control and 24,25 D3 vs. control ($\alpha=0.05$).

1. Chondroitin Sulfate Treatment

Chondrocytes were treated with chondroitin sulfate based on the recognition of chondroitin sulfate as a joint nutrient. Chondrocyte beads were treated with 100 µg/mL, 10 µg/mL or 0 µg/mL (control) chondroitin sulfate (n=3) for 1 week in DMEM/F12+P/S+10% FBS. Media was changed every other day. After one week, the chondrocytes beads were dissolved in sodium citrate (55 mM) and EDTA (30 mM). Suspensions were centrifuged at 1800 rpm for 10 minutes. Cells were washed with phosphate buffer and centrifuged again at 1800 rpm for 5 minutes. One mL lysis binding solution (Ambion® RNAqueous™) was added to the isolated canine chondrocyte pellet, mixed thoroughly and stored at −20° C. until RNA isolation could be performed. One sample from the chondroitin sulfate treatment was removed due to poor correlation with the rest of the array data. This reduced this analysis to an n=3. The results are shown in Tables 7-12.

TABLE 7

Differential Expression of OA-Associated Genes with Chondroitin Sulfate Treatment Comparing the Effect of 100 µg/mL and 10 µg/mL Chondroitin Sulfate on Chondrocytes ($p < 0.5$)

| Gene ID | DIF (100-10) | Fold |
|---|---|---|
| 1071b | −0.21 | 1.15 |
| 1089d | 0.23 | 1.17 |
| 1221a | −0.19 | 1.14 |
| 1228a | −0.44 | 1.36 |
| 1263b | −0.22 | 1.16 |
| 1304a | −0.14 | 1.10 |
| 143.2c | 0.22 | 1.16 |
| 1477a | −0.22 | 1.17 |
| 1576a | −0.30 | 1.23 |
| 1577a | −0.12 | 1.09 |
| 158a | −0.23 | 1.17 |
| 1717a | −0.29 | 1.22 |
| 1732a | −0.10 | 1.07 |
| 1747a | −0.16 | 1.12 |
| 1749a | −0.49 | 1.40 |
| 1752a | −0.30 | 1.23 |
| 1917f | −0.43 | 1.35 |
| 2173a | −0.63 | 1.54 |
| 2267a | −0.55 | 1.47 |
| 2374a | −0.54 | 1.46 |
| 322a | −0.41 | 1.33 |
| 368b | −0.17 | 1.12 |
| 392a | −0.07 | 1.05 |
| 508 | −0.17 | 1.12 |
| 639a | −0.26 | 1.20 |
| 711a | −0.24 | 1.18 |
| 720a | −0.17 | 1.12 |
| 73b | −0.24 | 1.18 |
| 753b | −0.26 | 1.20 |
| 831a | −0.38 | 1.30 |
| 91f | −0.27 | 1.21 |
| 936b | −0.21 | 1.16 |
| 997a | 0.15 | 1.11 |

TABLE 8

Differential Expression of OA-Associated Genes with Chondroitin Sulfate Treatment Comparing the Effect of 100 µg/mL and 0 µg/mL Chondroitin Sulfate (Control) on Chondrocytes ($p < 0.5$)

| Gene ID | DIF (100-Control) | Fold |
|---|---|---|
| 1044c | 0.19 | 1.14 |
| 1136b | −0.32 | 1.25 |
| 1137b | −0.20 | 1.15 |
| 1212b | −0.31 | 1.24 |
| 1248b | −0.24 | 1.18 |
| 1254a | 0.13 | 1.09 |
| 1304a | −0.35 | 1.28 |
| 143.2c | 0.28 | 1.21 |
| 1450a | −0.12 | 1.09 |
| 1457b | 0.10 | 1.07 |
| 1524a | 0.24 | 1.18 |
| 159a | 0.84 | 1.79 |
| 1741a | −0.42 | 1.34 |
| 1801b | 0.26 | 1.20 |
| 1880a | −0.75 | 1.68 |
| 1911b | −0.24 | 1.18 |
| 1930a | −0.34 | 1.27 |
| 297a | −0.31 | 1.24 |
| 398b | −0.34 | 1.27 |
| 466b | −0.38 | 1.30 |
| 487a | −0.21 | 1.16 |
| 538a | −0.25 | 1.19 |
| 713a | −0.20 | 1.15 |
| 720a | −0.21 | 1.16 |
| 739a | −0.29 | 1.22 |
| 795a | −0.43 | 1.35 |
| 831a | −0.18 | 1.13 |
| 85.2b | −0.25 | 1.19 |
| 961a | −0.31 | 1.24 |
| 995a | −0.60 | 1.52 |
| 999a | −0.35 | 1.27 |

TABLE 9

Differential Expression of OA-Associated Genes with Chondroitin Sulfate Treatment Comparing the Effect of 10 µg/mL and 0 µg/mL Chondroitin Sulfate (Control) on Chondrocytes ($p < 0.5$)

| Gene ID | DIF (10-Control) | Fold |
|---|---|---|
| 1050a | −0.27 | 1.21 |
| 1097c | −0.35 | 1.27 |
| 1163d | 0.18 | 1.13 |
| 1366a | −0.12 | 1.09 |
| 1406a | 0.13 | 1.10 |
| 145b | 0.35 | 1.28 |
| 1554c | −0.73 | 1.66 |
| 170a | 0.20 | 1.15 |
| 1764a | −0.11 | 1.08 |
| 1911b | −0.29 | 1.23 |
| 2088a | −0.13 | 1.10 |
| 2105a | 0.23 | 1.17 |
| 2205a | −0.27 | 1.20 |
| 2266b | −0.16 | 1.12 |
| 33a | 0.38 | 1.31 |
| 406a-r | −0.02 | 1.01 |
| 708a | 0.13 | 1.10 |
| 768a | 0.81 | 1.75 |
| 840d-r | −0.19 | 1.14 |
| 93e | 0.14 | 1.10 |

TABLE 10

Differential Expression of OA-Associated Genes with Chondroitin Sulfate Treatment Comparing the Effect of 100 µg/mL and 10 µg/mL Chondroitin Sulfate on Chondrocytes; Dataset shows a Unidirectional Trend in Fold Change Across All Samples

| Gene ID | DIF (100-10) | Fold |
|---|---|---|
| 491 | 1.21 | 2.32 |
| 498 | 0.18 | 1.13 |
| 508 | −0.17 | 1.12 |
| 1016b | 0.36 | 1.28 |
| 1044c | 0.33 | 1.26 |
| 1089d | 0.23 | 1.17 |
| 1091b | 0.18 | 1.13 |
| 1106a | −0.25 | 1.19 |
| 111a | −0.11 | 1.08 |
| 1129a | −0.22 | 1.17 |
| 1133b | −0.12 | 1.09 |
| 1137b | 0.20 | 1.15 |
| 11b | 0.69 | 1.61 |
| 1212b | −0.24 | 1.18 |
| 1217a | −0.34 | 1.27 |
| 1221a | −0.19 | 1.14 |
| 1225b | −0.23 | 1.17 |
| 1228a | −0.44 | 1.36 |
| 1254a | 0.15 | 1.11 |
| 1263b | −0.22 | 1.16 |
| 127b | 0.31 | 1.24 |
| 128a | −0.43 | 1.35 |
| 129b | 0.26 | 1.20 |
| 1304a | −0.14 | 1.10 |
| 132a | −0.35 | 1.27 |
| 1364d | 0.29 | 1.22 |
| 1403a | −0.25 | 1.19 |
| 1406a | −0.14 | 1.11 |
| 1409b | −0.22 | 1.17 |
| 1416a | −0.33 | 1.25 |
| 142.1c | −0.11 | 1.08 |
| 142.2c | 0.76 | 1.70 |
| 143.2c | 0.22 | 1.16 |
| 144.1c | 0.82 | 1.77 |
| 1453a | −0.13 | 1.09 |
| 1477a | −0.22 | 1.17 |
| 1489a | −0.18 | 1.14 |
| 1519a | 0.42 | 1.34 |
| 1532a | 0.22 | 1.16 |
| 154a | 0.04 | 1.03 |
| 1577a | −0.12 | 1.09 |
| 158a | −0.23 | 1.17 |
| 159a | 0.90 | 1.87 |
| 1612a | −0.13 | 1.10 |
| 1629a | −0.17 | 1.13 |
| 163a | −0.27 | 1.20 |
| 1646a | −0.06 | 1.04 |
| 1693b | −0.08 | 1.06 |
| 1705a | −0.34 | 1.26 |
| 1717a | −0.29 | 1.22 |
| 1732a | −0.10 | 1.07 |
| 1739a | −0.05 | 1.03 |
| 173a | −0.48 | 1.40 |
| 1741a | −0.21 | 1.16 |
| 1747a | −0.16 | 1.12 |
| 1749a | −0.49 | 1.40 |
| 1752a | −0.30 | 1.23 |
| 1760c | −0.09 | 1.07 |
| 1772a | −0.36 | 1.28 |
| 186a | 0.27 | 1.21 |
| 1874b | −0.18 | 1.13 |
| 1880a | −0.40 | 1.32 |
| 1881b | −0.11 | 1.08 |
| 1892a | 0.24 | 1.18 |
| 1945a | −0.07 | 1.05 |
| 1989b | −0.02 | 1.02 |
| 1990a | −0.37 | 1.29 |
| 2002c | −0.16 | 1.12 |
| 2008a | −0.05 | 1.03 |
| 2013a | 0.05 | 1.04 |
| 2023b | −0.17 | 1.12 |
| 2047b | −0.17 | 1.13 |

TABLE 10-continued

Differential Expression of OA-Associated Genes with Chondroitin Sulfate Treatment Comparing the Effect of 100 μg/mL and 10 μg/mL Chondroitin Sulfate on Chondrocytes; Dataset shows a Unidirectional Trend in Fold Change Across All Samples

| Gene ID | DIF (100-10) | Fold |
|---|---|---|
| 2083e | −0.28 | 1.21 |
| 2095a | −0.48 | 1.40 |
| 2102a | −0.64 | 1.56 |
| 2108b | −0.13 | 1.09 |
| 2109a | −0.41 | 1.33 |
| 2117b | −0.37 | 1.29 |
| 211b | 0.40 | 1.32 |
| 2148a | 0.10 | 1.07 |
| 2173a | −0.63 | 1.54 |
| 2182b | 0.26 | 1.20 |
| 2205a | 0.34 | 1.27 |
| 2221c | 0.21 | 1.16 |
| 2223a | −0.22 | 1.17 |
| 2267a | −0.55 | 1.47 |
| 2374a | −0.54 | 1.46 |
| 27a | −0.14 | 1.10 |
| 297a | −0.17 | 1.12 |
| 307b | 0.15 | 1.11 |
| 309a | 0.42 | 1.34 |
| 322a | −0.41 | 1.33 |
| 106a | 0.15 | 1.11 |
| 106a | 0.18 | 1.13 |
| 368b | −0.17 | 1.12 |
| 379a | −0.15 | 1.11 |
| 392a | −0.07 | 1.05 |
| 410c | −0.22 | 1.17 |
| 425c | −0.25 | 1.19 |
| 455c | −0.01 | 1.01 |
| 468f | −0.19 | 1.14 |
| 472a | −0.46 | 1.38 |
| 483a | 0.15 | 1.11 |
| 545a | −0.12 | 1.08 |
| 553b | 0.38 | 1.31 |
| 596e | −0.10 | 1.07 |
| 60a | −0.40 | 1.32 |
| 623a | 0.64 | 1.56 |
| 639a | −0.26 | 1.20 |
| 63a | −0.25 | 1.19 |
| 67a | −0.56 | 1.47 |
| 704b | −0.39 | 1.31 |
| 711a | −0.24 | 1.18 |
| 713a | −0.26 | 1.20 |
| 718a | −0.18 | 1.14 |
| 720a | −0.17 | 1.12 |
| 736a | −1.16 | 2.23 |
| 737a | −0.22 | 1.16 |
| 73b | −0.24 | 1.18 |
| 753b | −0.26 | 1.20 |
| 759b | −0.28 | 1.21 |
| 795a | −0.19 | 1.14 |
| 812d-r | −0.19 | 1.14 |
| 831a | −0.38 | 1.30 |
| 833a | −0.28 | 1.22 |
| 84.2c | −0.33 | 1.26 |
| 840d-r | 0.28 | 1.22 |
| 841b | −0.31 | 1.24 |
| 847a | −0.18 | 1.13 |
| 87.2b | −0.41 | 1.33 |
| 878c | −0.25 | 1.19 |
| 8a | −0.21 | 1.16 |
| 90c | −0.25 | 1.19 |
| 91f | −0.27 | 1.21 |
| 929a | −0.72 | 1.64 |
| 936b | −0.21 | 1.16 |
| 93e | −0.30 | 1.23 |
| 945a | −0.27 | 1.20 |
| 990a | −0.19 | 1.14 |
| 995a | −0.35 | 1.27 |
| 999a | −0.12 | 1.09 |

TABLE 11

Differential Expression of OA-Associated Genes with Chondroitin Sulfate Treatment Comparing the Effect of 100 μg/mL and 0 μg/mL (Control) Chondroitin Sulfate on Chondrocytes; Dataset shows a Unidirectional Trend in Fold Change Across All Samples

| Gene ID | DIF (100-Control) | Fold |
|---|---|---|
| 1002b | −0.18 | 1.13 |
| 1026b | −0.11 | 1.08 |
| 1044c | 0.19 | 1.14 |
| 106a | 0.13 | 1.10 |
| 1133b | −0.20 | 1.15 |
| 1136b | −0.32 | 1.25 |
| 1137b | −0.20 | 1.15 |
| 1138a | −0.32 | 1.25 |
| 1159b | 0.17 | 1.12 |
| 1183a | 0.18 | 1.13 |
| 1189a | 0.12 | 1.09 |
| 11b | 1.14 | 2.20 |
| 1212b | −0.31 | 1.24 |
| 1217a | −0.45 | 1.37 |
| 1228a | −0.34 | 1.26 |
| 1240a | −0.03 | 1.02 |
| 1246a | −0.04 | 1.03 |
| 1248b | −0.24 | 1.18 |
| 1254a | 0.13 | 1.09 |
| 1294b | 0.40 | 1.32 |
| 1304a | −0.35 | 1.28 |
| 1366a | −0.26 | 1.19 |
| 136b | −0.41 | 1.33 |
| 1394b | −0.19 | 1.14 |
| 1403a | −0.28 | 1.21 |
| 1405c | −0.02 | 1.02 |
| 1409b | −0.15 | 1.11 |
| 141c | 0.58 | 1.50 |
| 142.2c | 1.01 | 2.02 |
| 1423b | −0.12 | 1.09 |
| 143.2c | 0.28 | 1.21 |
| 1450a | −0.12 | 1.09 |
| 1456b | −0.09 | 1.06 |
| 146b | 0.27 | 1.21 |
| 1472a | 0.16 | 1.12 |
| 1477a | −0.45 | 1.37 |
| 1489a | −0.37 | 1.29 |
| 1519a | 0.18 | 1.13 |
| 154a | −0.11 | 1.08 |
| 156b | 0.35 | 1.27 |
| 158a | −0.27 | 1.21 |
| 159a | 0.84 | 1.79 |
| 15b | −0.29 | 1.22 |
| 1612a | −0.34 | 1.27 |
| 1630b | −0.24 | 1.18 |
| 1631d | −0.26 | 1.20 |
| 1632a | −0.23 | 1.17 |
| 163a | −0.40 | 1.32 |
| 1695a | 0.05 | 1.03 |
| 1705a | −0.46 | 1.37 |
| 1715a | −0.14 | 1.10 |
| 1717a | −0.24 | 1.18 |
| 1732a | −0.10 | 1.07 |
| 1734b | −0.27 | 1.21 |
| 1740a | −0.07 | 1.05 |
| 1741a | −0.42 | 1.34 |
| 1747a | −0.10 | 1.07 |
| 1749a | −0.36 | 1.28 |
| 1752a | −0.26 | 1.20 |
| 1758a | −0.21 | 1.16 |
| 1772a | −0.06 | 1.05 |
| 1811b | −0.19 | 1.14 |
| 1813b | −0.13 | 1.10 |
| 1874b | −0.36 | 1.29 |
| 1911b | −0.24 | 1.18 |
| 1917f | −0.41 | 1.33 |
| 1928a | −0.16 | 1.12 |
| 1930a | −0.34 | 1.27 |
| 1945a | −0.26 | 1.20 |
| 1948b | 0.14 | 1.10 |
| 2013a | −0.17 | 1.12 |
| 2035d | −0.30 | 1.24 |

TABLE 11-continued

Differential Expression of OA-Associated Genes with Chondroitin Sulfate Treatment Comparing the Effect of 100 µg/mL and 0 µg/mL (Control) Chondroitin Sulfate on Chondrocytes; Dataset shows a Unidirectional Trend in Fold Change Across All Samples

| Gene ID | DIF (100-Control) | Fold |
|---|---|---|
| 2047b | −0.22 | 1.17 |
| 205a | −0.29 | 1.22 |
| 2088a | −0.18 | 1.14 |
| 2129a | −0.17 | 1.12 |
| 2136b | 0.23 | 1.17 |
| 2154a | −0.21 | 1.16 |
| 2266b | −0.18 | 1.14 |
| 2267a | −0.55 | 1.47 |
| 2374a | −0.54 | 1.45 |
| 297a | −0.31 | 1.24 |
| 319b | −0.39 | 1.31 |
| 322a | −0.36 | 1.28 |
| 32e | 0.19 | 1.14 |
| 33a | 0.20 | 1.15 |
| 106a | 0.32 | 1.25 |
| 106a | 0.15 | 1.11 |
| 392a | −0.15 | 1.11 |
| 398b | −0.34 | 1.27 |
| 401a | −0.20 | 1.15 |
| 406a-r | −0.03 | 1.02 |
| 421a | −0.19 | 1.14 |
| 425c | −0.36 | 1.28 |
| 44a | −0.18 | 1.13 |
| 472a | −0.29 | 1.22 |
| 487a | −0.21 | 1.16 |
| 50.2d | −0.25 | 1.19 |
| 538a | −0.25 | 1.19 |
| 553b | 0.28 | 1.21 |
| 568a | −0.15 | 1.11 |
| 57a | −0.18 | 1.13 |
| 596e | −0.17 | 1.13 |
| 59a | 0.39 | 1.31 |
| 60a | −0.30 | 1.23 |
| 616a | −0.19 | 1.14 |
| 61c | −0.14 | 1.10 |
| 639a | −0.26 | 1.20 |
| 63a | −0.18 | 1.13 |
| 6b | 0.18 | 1.13 |
| 713a | −0.20 | 1.15 |
| 720a | −0.21 | 1.16 |
| 72a | −0.22 | 1.17 |
| 736a | −0.71 | 1.63 |
| 739a | −0.29 | 1.22 |
| 749a | −0.24 | 1.18 |
| 794a | −0.12 | 1.08 |
| 795a | −0.43 | 1.35 |
| 828a | −0.49 | 1.40 |
| 82b | 0.21 | 1.16 |
| 831a | −0.18 | 1.13 |
| 833a | −0.26 | 1.20 |
| 84.1b | −0.10 | 1.07 |
| 84.2c | −0.35 | 1.28 |
| 844c-r | −0.09 | 1.06 |
| 85.2b | −0.25 | 1.19 |
| 890a | −0.08 | 1.06 |
| 91f | −0.15 | 1.11 |
| 936b | −0.15 | 1.11 |
| 953a | −0.04 | 1.03 |
| 961a | −0.31 | 1.24 |
| 995a | −0.60 | 1.52 |
| 996a | −0.08 | 1.06 |
| 999a | −0.35 | 1.27 |

TABLE 12

Differential Expression of OA-Associated Genes with Chondroitin Sulfate Treatment Comparing the Effect of 10 µg/mL and 0 µg/mL (Control) Chondroitin Sulfate on Chondrocytes; Dataset shows a Unidirectional Trend in Fold Change Across All Samples

| Gene ID | DIF (10-C) | Fold |
|---|---|---|
| 491 | −1.37 | 2.59 |
| 493 | −0.05 | 1.04 |
| 498 | −0.35 | 1.27 |
| 1016b | −0.50 | 1.42 |
| 1050a | −0.27 | 1.21 |
| 1072a | −0.48 | 1.40 |
| 1089d | −0.21 | 1.15 |
| 1105a | −0.40 | 1.32 |
| 1136b | −0.32 | 1.25 |
| 1137b | −0.39 | 1.31 |
| 1139a | −0.07 | 1.05 |
| 1145a | −0.11 | 1.08 |
| 1174d | −0.45 | 1.36 |
| 1217a | −0.11 | 1.08 |
| 1247a | −0.20 | 1.15 |
| 1304a | −0.21 | 1.15 |
| 131a | −0.21 | 1.16 |
| 1366a | −0.12 | 1.09 |
| 1406a | 0.13 | 1.10 |
| 1409b | 0.07 | 1.05 |
| 1411a | −0.18 | 1.13 |
| 145b | 0.35 | 1.28 |
| 1500b | −0.24 | 1.18 |
| 1521b | −0.19 | 1.14 |
| 154a | −0.15 | 1.11 |
| 1632a | −0.20 | 1.15 |
| 1656a | 0.16 | 1.12 |
| 1721a | −0.19 | 1.14 |
| 1739a | 0.07 | 1.05 |
| 173a | 0.37 | 1.29 |
| 1741a | −0.21 | 1.16 |
| 1747a | 0.07 | 1.05 |
| 1758a | −0.19 | 1.14 |
| 1764a | −0.11 | 1.08 |
| 1772a | 0.29 | 1.22 |
| 1811b | −0.16 | 1.12 |
| 1852a | 0.38 | 1.30 |
| 1892a | −0.35 | 1.28 |
| 1895b | 0.06 | 1.04 |
| 1908a | −0.12 | 1.09 |
| 1930a | −0.22 | 1.16 |
| 1945a | −0.19 | 1.14 |
| 1948b | 0.19 | 1.14 |
| 2013a | −0.22 | 1.17 |
| 2088a | −0.13 | 1.10 |
| 2105a | 0.23 | 1.17 |
| 2109a | 0.68 | 1.61 |
| 2149d | −0.14 | 1.10 |
| 2205a | −0.27 | 1.20 |
| 2266b | −0.16 | 1.12 |
| 307b | −0.14 | 1.10 |
| 319b | −0.11 | 1.08 |
| 326e | 0.22 | 1.17 |
| 32e | 0.18 | 1.14 |
| 33a | 0.38 | 1.31 |
| 348c | 0.15 | 1.11 |
| 379a | 0.21 | 1.16 |
| 406a-r | −0.02 | 1.01 |
| 413a | −0.17 | 1.12 |
| 421a | −0.13 | 1.10 |
| 472a | 0.17 | 1.13 |
| 489c | 0.04 | 1.03 |
| 530b | −0.24 | 1.18 |
| 538a | −0.48 | 1.39 |
| 56a | 0.06 | 1.04 |
| 57a | −0.22 | 1.17 |
| 583e | −0.22 | 1.17 |
| 64.2a | −0.24 | 1.18 |
| 704b | 0.23 | 1.17 |
| 708a | 0.13 | 1.10 |
| 719a | −0.35 | 1.28 |
| 737a | 0.11 | 1.08 |

TABLE 12-continued

Differential Expression of OA-Associated Genes with Chondroitin Sulfate Treatment Comparing the Effect of 10 μg/mL and 0 μg/mL (Control) Chondroitin Sulfate on Chondrocytes; Dataset shows a Unidirectional Trend in Fold Change Across All Samples

| Gene ID | DIF (10-C) | Fold |
|---|---|---|
| 749a | −0.29 | 1.23 |
| 753b | 0.21 | 1.15 |
| 75c | 0.24 | 1.19 |
| 795a | −0.25 | 1.19 |
| 828a | −0.65 | 1.57 |
| 831a | 0.20 | 1.15 |
| 840d-r | −0.19 | 1.14 |
| 848a | 0.09 | 1.07 |
| 87.2b | 0.42 | 1.34 |
| 90c | 0.27 | 1.20 |
| 91f | 0.13 | 1.09 |
| 93e | 0.14 | 1.10 |
| 945a | 0.26 | 1.20 |
| 961a | −0.31 | 1.24 |
| 98d | 0.15 | 1.11 |
| 995a | −0.25 | 1.19 |
| 999a | −0.23 | 1.17 |

2. Glucosamine Treatment

Glucosamine treatment was used to determine the effect of this joint health nutrient on the differential expression of OA-associated genes. Chondrocyte beads were treated with 100 μg/mL, 10 μg/mL or 0 μg/mL (control) glucosamine (n=3) for 1 week in DMEM/F12+P/S+10% FBS. Media was changed every other day. After one week, the chondrocytes beads were dissolved in sodium citrate (55 mM) and EDTA (30 mM). Suspensions were centrifuged at 1800 rpm for 10 minutes. Cells were washed with phosphate buffer and centrifuged again at 1800 rpm for 5 minutes. One mL lysis binding solution (Ambion® RNAqueous™) was added to the isolated canine chondrocyte pellet, mixed thoroughly and stored at −20° C. until RNA isolation could be performed. The results are shown in Tables 13-18.

TABLE 13

Differential Expression of OA-Associated Genes with Glucosamine Treatment Comparing the Effect of 100 μg/mL and 10 μg/mL Glucosamine on Chondrocytes ($p < 0.5$)

| Gene ID | DIF (100-10) | Fold |
|---|---|---|
| 1044c | −1.12 | 2.17 |
| 10c | −0.48 | 1.39 |
| 1131b | −0.80 | 1.74 |
| 1183a | −0.43 | 1.34 |
| 1257b | 0.46 | 1.38 |
| 1479a | −0.49 | 1.41 |
| 1532a | 0.34 | 1.27 |
| 1656a | −0.73 | 1.66 |
| 170a | −0.56 | 1.47 |
| 1896b | −0.59 | 1.51 |
| 2085c | −0.44 | 1.36 |
| 2137b | −0.67 | 1.59 |
| 322a | 0.41 | 1.32 |
| 687a | −0.46 | 1.38 |
| 695a | −0.51 | 1.42 |
| 841b | 0.79 | 1.73 |

TABLE 14

Differential Expression of OA-Associated Genes with Glucosamine Treatment Comparing the Effect of 100 μg/mL and 0 μg/mL (Control) Glucosamine on Chondrocytes ($p < 0.5$)

| Gene ID | DIF (100-C) | Fold |
|---|---|---|
| 1413b | −1.73 | 3.31 |
| 1892a | 0.94 | 1.92 |

TABLE 15

Differential Expression of OA-Associated Genes with Glucosamine Treatment Comparing the Effect of 10 μg/mL and 0 μg/mL (Control) Glucosamine on Chondrocytes ($p < 0.5$)

| Gene ID | DIF (10-C) | Fold |
|---|---|---|
| 1294b | −0.55 | 1.46 |
| 1364d | −0.67 | 1.59 |
| 1384a | 1.61 | 3.04 |
| 150a | 1.23 | 2.34 |
| 151b | 1.18 | 2.27 |
| 1645a | 0.43 | 1.34 |
| 2100b | −0.34 | 1.26 |
| 2198b | 0.76 | 1.70 |
| 2210a | −0.51 | 1.43 |
| 38a | −0.57 | 1.48 |
| 457c | −1.57 | 2.96 |
| 464b | −0.34 | 1.27 |
| 623a | −0.56 | 1.47 |
| 63a | 0.20 | 1.15 |
| 794a | −0.24 | 1.18 |

TABLE 16

Differential Expression of OA-Associated Genes with Glucosamine Treatment Comparing the Effect of 100 μg/mL and 10 μg/mL Glucosamine on Chondrocytes; Dataset shows a Unidirectional Trend in Fold Change Across All Samples

| Gene ID | DIF (100-10) | Fold |
|---|---|---|
| 508 | −0.41 | 1.33 |
| 1004a | −0.68 | 1.60 |
| 1023c | −0.58 | 1.49 |
| 1026b | −0.52 | 1.43 |
| 1030a | −0.70 | 1.63 |
| 1044c | −1.12 | 2.17 |
| 1089d | −0.42 | 1.34 |
| 1094b | −0.35 | 1.28 |
| 1099c | −0.66 | 1.58 |
| 10c | −0.48 | 1.39 |
| 1104b | −0.79 | 1.73 |
| 1110b | −0.59 | 1.50 |
| 1131b | −0.80 | 1.74 |
| 1159b | −0.86 | 1.81 |
| 1183a | −0.43 | 1.34 |
| 1227b | −1.55 | 2.94 |
| 131a | −0.70 | 1.62 |
| 1405c | −0.40 | 1.32 |
| 1406a | −0.58 | 1.49 |
| 1423b | −0.73 | 1.66 |
| 1437a | −0.55 | 1.47 |
| 1479a | −0.49 | 1.41 |
| 1500b | −0.97 | 1.95 |
| 150a | −0.72 | 1.64 |
| 1584a | −0.80 | 1.74 |
| 1594a | −1.04 | 2.05 |
| 159a | 0.56 | 1.48 |
| 1626c | −0.82 | 1.77 |
| 1639a | −0.58 | 1.50 |
| 1656a | −0.73 | 1.66 |

TABLE 16-continued

Differential Expression of OA-Associated Genes with Glucosamine Treatment Comparing the Effect of 100 µg/mL and 10 µg/mL Glucosamine on Chondrocytes; Dataset shows a Unidirectional Trend in Fold Change Across All Samples

| Gene ID | DIF (100-10) | Fold |
| --- | --- | --- |
| 1669d | −0.69 | 1.61 |
| 1670d | −1.20 | 2.30 |
| 1849d | −0.54 | 1.45 |
| 1895b | −0.22 | 1.16 |
| 1896b | −0.59 | 1.51 |
| 2085c | −0.44 | 1.36 |
| 2092c | −0.52 | 1.43 |
| 2104a | −0.67 | 1.59 |
| 2117b | −1.00 | 1.99 |
| 2137b | −0.67 | 1.59 |
| 2167a | −0.83 | 1.77 |
| 2267a | −1.12 | 2.18 |
| 260c | −0.63 | 1.55 |
| 370a | 0.24 | 1.18 |
| 413a | −0.40 | 1.32 |
| 421a | −0.58 | 1.49 |
| 48b | −0.89 | 1.85 |
| 687a | −0.46 | 1.38 |
| 695a | −0.51 | 1.42 |
| 706b | −0.39 | 1.31 |
| 720a | −0.42 | 1.34 |
| 847a | −0.50 | 1.41 |
| 863c-r | −0.45 | 1.36 |
| 87.2b | −0.87 | 1.83 |
| 906a | −0.36 | 1.28 |
| 981a | −0.70 | 1.62 |

TABLE 17

Differential Expression of OA-Associated Genes with Glucosamine Treatment Comparing the Effect of 100 µg/mL and 0 µg/mL (Control) Glucosamine on Chondrocytes; Dataset shows a Unidirectional Trend in Fold Change Across All Samples

| Gene ID | DIF (100-C) | Fold |
| --- | --- | --- |
| 491 | 0.56 | 1.47 |
| 1026b | −0.30 | 1.23 |
| 1030a | −0.50 | 1.41 |
| 1040b | −0.63 | 1.55 |
| 106a | 0.23 | 1.17 |
| 1094b | −0.14 | 1.10 |
| 111a | −0.85 | 1.81 |
| 1227b | −1.15 | 2.23 |
| 1413b | −1.73 | 3.31 |
| 146b | −0.57 | 1.49 |
| 1500b | −1.51 | 2.85 |
| 158a | −1.07 | 2.10 |
| 1630b | −1.23 | 2.34 |
| 1669d | −0.24 | 1.19 |
| 1670d | −0.26 | 1.20 |
| 2048a | −0.27 | 1.20 |
| 2331c | −0.74 | 1.67 |
| 283a | −0.69 | 1.62 |
| 370a | 0.15 | 1.11 |
| 375d | −0.22 | 1.16 |
| 384c | −0.39 | 1.31 |

TABLE 18

Differential Expression of OA-Associated Genes with Glucosamine Treatment Comparing the Effect of 10 µg/mL and 0 µg/mL (Control) Glucosamine on Chondrocytes; Dataset shows a Unidirectional Trend in Fold Change Across All Samples

| Gene ID | DIF (10-Control) | Fold |
| --- | --- | --- |
| 1006b | −0.79 | 1.73 |
| 104a | −0.53 | 1.44 |
| 106a | 0.24 | 1.18 |
| 1072a | 0.52 | 1.44 |
| 1089d | 0.63 | 1.54 |
| 111a | −0.29 | 1.22 |
| 104a | −0.20 | 1.15 |
| 1190b | −0.52 | 1.43 |
| 130b | 0.35 | 1.28 |
| 1364d | −0.67 | 1.59 |
| 1384a | 1.61 | 3.04 |
| 1400a | −0.66 | 1.58 |
| 1405c | 0.66 | 1.58 |
| 1437a | 0.56 | 1.47 |
| 1466b | −0.75 | 1.68 |
| 146b | −0.27 | 1.20 |
| 1469a | 0.57 | 1.48 |
| 150a | 1.23 | 2.34 |
| 151b | 1.18 | 2.27 |
| 1554c | −0.34 | 1.27 |
| 1631d | 0.48 | 1.39 |
| 1645a | 0.43 | 1.34 |
| 1670d | 0.94 | 1.92 |
| 1683a | −1.36 | 2.57 |
| 1712a | 0.18 | 1.14 |
| 1948b | 0.25 | 1.19 |
| 1a | −1.05 | 2.07 |
| 2095a | −0.94 | 1.92 |
| 2117b | 1.14 | 2.20 |
| 262c | −0.18 | 1.14 |
| 27a | 0.10 | 1.07 |
| 283a | −0.32 | 1.25 |
| 421a | 0.55 | 1.46 |
| 45.1b | 0.15 | 1.11 |
| 457c | −1.57 | 2.96 |
| 459a | −0.40 | 1.32 |
| 468f | 0.34 | 1.27 |
| 483a | −0.37 | 1.29 |
| 489c | 0.22 | 1.16 |
| 490c | 0.17 | 1.13 |
| 50.2d | 0.30 | 1.23 |
| 52a | −1.14 | 2.20 |
| 530b | −0.24 | 1.18 |
| 553b | 0.26 | 1.20 |
| 557b | −0.17 | 1.13 |
| 63a | 0.20 | 1.15 |
| 795a | 0.28 | 1.21 |
| 986a | −0.61 | 1.52 |
| 98d | 0.17 | 1.13 |
| 996a | 0.77 | 1.71 |

3. 1α,25-dihydroxyvitamin $D_3$ (1,25 D3) and 24R,25-dihydroxyvitamin $D_3$ (24,25 D3) Treatment 1,25 D3 and 24R,25D3 treatment was applied to chondrocytes based on their known effects on prostaglandin production and differential responses to the vitamin D3 metabolites in chondrocytes to determine the effect of these compounds on OA-associated gene expression. Chondrocyte beads were treated with $10^{-7}$M 1,25 D3 or $10^{-7}$M 24,25 D3 for 24 hours or without Vitamin D (equivalent ethanol was added to control), (n=3) in DMEM/F12+P/S+10% FBS. After 24 hours, the chondrocyte beads were dissolved in sodium citrate (55 mM) and EDTA (30 mM). Suspensions were centrifuged at 1800 rpm for 10 minutes. Cells were washed with phosphate buffer and centrifuged again at 1800 rpm for 5 minutes. One mL lysis binding solution (Ambion® RNAqueous™) was added to the isolated canine chondrocyte pellet, mixed thoroughly and stored at −20° C. until RNA isolation could be performed. The results are shown in Tables 19 and 20.

TABLE 19

Differential Expression of OA-Associated Genes with 1α,25-dihydroxyvitamin $D_3$ Treatment on Chondrocytes (p < 0.5)

| Gene ID | median C | median 1,25 vD3 | DIF (1,25-Control) | Fold |
|---|---|---|---|---|
| 1023c | 10.95 | 10.12 | −0.83 | 1.77 |
| 1042a | 11.30 | 10.86 | −0.44 | 1.36 |
| 1068a | 9.62 | 8.89 | −0.73 | 1.66 |
| 1096a | 9.68 | 9.36 | −0.32 | 1.25 |
| 1101a | 7.76 | 7.16 | −0.60 | 1.51 |
| 1103a | 7.92 | 7.29 | −0.63 | 1.55 |
| 1120a | 8.17 | 7.77 | −0.40 | 1.32 |
| 1147a | 8.04 | 7.43 | −0.61 | 1.52 |
| 117.1d | 8.60 | 8.16 | −0.44 | 1.35 |
| 1174d | 9.66 | 8.30 | −1.36 | 2.57 |
| 1178a | 8.12 | 7.55 | −0.57 | 1.49 |
| 1275c | 8.72 | 8.07 | −0.64 | 1.56 |
| 1304a | 8.92 | 8.07 | −0.85 | 1.80 |
| 1447a | 9.67 | 9.21 | −0.46 | 1.37 |
| 1461a | 7.89 | 6.96 | −0.92 | 1.90 |
| 1503c | 8.86 | 8.47 | −0.40 | 1.32 |
| 1521b | 9.79 | 8.50 | −1.29 | 2.44 |
| 153b | 8.49 | 8.03 | −0.46 | 1.37 |
| 1554c | 9.09 | 8.49 | −0.61 | 1.52 |
| 1576a | 8.27 | 7.66 | −0.61 | 1.52 |
| 1582a | 8.10 | 7.62 | −0.47 | 1.39 |
| 1592a | 8.03 | 7.35 | −0.67 | 1.59 |
| 1601a | 7.68 | 7.30 | −0.38 | 1.30 |
| 1612a | 10.11 | 8.71 | −1.40 | 2.64 |
| 1779b | 7.63 | 7.09 | −0.54 | 1.45 |
| 1813b | 11.20 | 10.19 | −1.01 | 2.02 |
| 1849d | 11.81 | 11.31 | −0.49 | 1.41 |
| 185a | 7.61 | 7.28 | −0.34 | 1.26 |
| 1863c | 10.52 | 9.95 | −0.57 | 1.49 |
| 1889a | 8.20 | 7.45 | −0.75 | 1.68 |
| 1892a | 9.71 | 8.90 | −0.81 | 1.75 |
| 1920a | 8.24 | 7.54 | −0.70 | 1.62 |
| 192a | 7.84 | 7.61 | −0.23 | 1.17 |
| 1943a | 7.71 | 7.35 | −0.36 | 1.28 |
| 1991d | 9.36 | 8.48 | −0.88 | 1.84 |
| 2109a | 10.56 | 11.72 | 1.16 | 2.23 |
| 2117b | 9.27 | 11.06 | 1.79 | 3.46 |
| 2163a | 8.69 | 7.49 | −1.20 | 2.30 |
| 2179a | 7.71 | 7.17 | −0.54 | 1.45 |
| 2198b | 9.71 | 8.36 | −1.35 | 2.54 |
| 2201a | 8.19 | 7.74 | −0.45 | 1.37 |
| 2223a | 15.42 | 14.58 | −0.84 | 1.79 |
| 2263b | 8.85 | 8.11 | −0.74 | 1.67 |
| 2266b | 8.69 | 7.92 | −0.77 | 1.71 |
| 2337a | 13.57 | 12.62 | −0.95 | 1.93 |
| 234a | 7.95 | 7.61 | −0.33 | 1.26 |
| 2353a | 8.43 | 7.96 | −0.47 | 1.38 |
| 299a | 7.62 | 7.90 | 0.29 | 1.22 |
| 106a | 16.00 | 15.99 | −0.01 | 1.00 |
| 367a | 10.83 | 10.22 | −0.61 | 1.52 |
| 388a | 7.81 | 7.52 | −0.29 | 1.22 |
| 415b | 7.86 | 7.33 | −0.53 | 1.44 |
| 478a | 9.24 | 8.85 | −0.38 | 1.30 |
| 5b | 10.21 | 9.71 | −0.51 | 1.42 |
| 61c | 10.58 | 9.88 | −0.70 | 1.62 |
| 719a | 10.62 | 10.27 | −0.35 | 1.27 |
| 721b | 9.08 | 8.62 | −0.46 | 1.38 |

TABLE 20

Differential Expression of OA-Associated Genes with 24R,25-dihydroxyvitamin $D_3$ Treatment on Chondrocytes (p < 0.5)

| Gene ID | median C | median 24,25 vD3 | DIF (24,25-Control) | Fold |
|---|---|---|---|---|
| 1023c | 11.11 | 10.48 | −0.64 | 1.56 |
| 1068a | 9.68 | 9.21 | −0.47 | 1.39 |
| 1098a | 7.01 | 8.18 | 1.17 | 2.25 |
| 1285a | 7.37 | 7.69 | 0.33 | 1.25 |
| 1335b | 7.85 | 7.69 | −0.16 | 1.12 |
| 1474a | 6.94 | 7.70 | 0.76 | 1.69 |
| 1481c | 7.70 | 7.39 | −0.31 | 1.24 |
| 1592a | 8.09 | 7.46 | −0.63 | 1.55 |
| 16b | 8.47 | 7.73 | −0.74 | 1.67 |
| 1726a | 7.88 | 7.37 | −0.50 | 1.42 |
| 1779b | 7.66 | 7.32 | −0.35 | 1.27 |
| 2330b | 8.01 | 7.74 | −0.27 | 1.21 |
| 340a | 7.71 | 8.41 | 0.69 | 1.62 |
| 371a | 9.33 | 9.60 | 0.26 | 1.20 |
| 401a-r | 7.17 | 7.55 | 0.39 | 1.31 |
| 449a | 7.29 | 7.59 | 0.30 | 1.23 |
| 70d | 7.88 | 8.23 | 0.35 | 1.28 |
| 725a | 7.42 | 8.23 | 0.81 | 1.75 |
| 832a | 8.37 | 9.04 | 0.67 | 1.59 |
| 996a | 14.73 | 14.52 | −0.22 | 1.16 |

4. Eicosapentaenoic acid (EPA) and Arachidonic Acid (AA) Treatment

Chondrocytes were treated with eicosapentaenoic acid (EPA) and arachidonic acid (AA) based on the recognition in the literature that EPA acts as an anti-inflammatory. AA was used as a control to represent a typical western diet. Chondrocytes were enriched with 50 μM EPA or 50 μM AA (using albumin as a carrier) for two weeks in DMEM/HAMS+P/S+ 10% FBS. Media was changed every other day. Each set (n=3) was split and half were treated with stimulated monocyte neutrophil conditioned media (SMNCM) for one week with media changed every other day. SMNCM was made by isolating monocytes and neutrophils from canine whole blood using NycoPrep™ according to the manufacture's directions. Monocytes and neutrophils were stimulated with lipopolysaccharide (20 ng/mL) for 72 hours. The resulting supernatant was used as SMNCM in cell culture experimentation (SMNCM made up 10% of media used during experimentation). Chondrocyte beads were dissolved in sodium citrate (55 mM) and EDTA (30 mM). Suspensions were centrifuged at 1800 rpm for 10 minutes. Cells were washed with phosphate buffer and centrifuged again at 1800 rpm for 5 minutes. One mL lysis binding solution (Ambion® RNAqueous™) was added to the isolated canine chondrocyte pellet, mixed thoroughly and stored at −20° C. until RNA isolation could be performed. One sample from the EPA/AA stim treatment was removed due to poor correlation with the rest of the array data. This reduced these analyses to an n=3. The results are shown in Tables 21-23.

TABLE 21

Differential Expression of OA-Associated Genes Comparing AA Treatment with EPA Treatment of Chondrocytes (p < 0.05)

| Gene ID | DIF (AA-EPA) | Fold |
|---|---|---|
| 1190b | 0.42 | 1.34 |
| 1381a | −0.12 | 1.08 |
| 1391a | 0.26 | 1.20 |
| 1450a | −0.64 | 1.56 |
| 1451a | −0.85 | 1.80 |
| 1466b | 0.33 | 1.26 |
| 1678a | −0.67 | 1.60 |
| 1730a | 0.45 | 1.36 |
| 2095a | −0.35 | 1.28 |
| 493 | −0.46 | 1.38 |

TABLE 21-continued

Differential Expression of OA-Associated Genes Comparing AA Treatment with EPA Treatment of Chondrocytes (p < 0.05)

| Gene ID | DIF (AA-EPA) | Fold |
|---|---|---|
| 708a | 0.51 | 1.43 |
| 99b | −0.17 | 1.13 |

TABLE 22

Differential Expression of OA-Associated Genes with Inflammatory Stimulation Comparing AA Treatment with EPA Treatment of Chondrocytes (p < 0.05)

| Gene ID | DIF (AAs-EPAs) | Fold |
|---|---|---|
| 1099c | 1.12 | 2.17 |
| 1104b | 0.73 | 1.66 |
| 1106a | 0.46 | 1.38 |
| 1184a | 0.54 | 1.45 |
| 1190b | 0.56 | 1.47 |
| 128a | −0.68 | 1.60 |
| 1323b-r | −0.58 | 1.50 |
| 1339b | −1.58 | 2.98 |
| 1391a | 0.88 | 1.84 |
| 1425a | 0.68 | 1.61 |
| 1459c | −0.38 | 1.30 |
| 154a | −1.27 | 2.42 |
| 1576a | −0.33 | 1.26 |
| 1629a | −0.58 | 1.49 |
| 1639a | 0.64 | 1.56 |
| 164c | −0.69 | 1.61 |
| 166a | −0.43 | 1.35 |
| 1752a | −0.27 | 1.20 |
| 2035d | −0.57 | 1.48 |
| 2113a | −0.90 | 1.86 |
| 2120a-r | 0.28 | 1.22 |
| 35c | −0.19 | 1.14 |
| 65.2a | −0.86 | 1.82 |
| 90c | −0.61 | 1.53 |

TABLE 23

Differential Expression of OA-Associated Genes with Inflammatory Stimulation Comparing EPA Treatment and AA Treatment of Chondrocytes (p < 0.05)

| Gene ID | AAs-AA | EPAs-EPA | DIF ((AAs-AA) − (EPAs-EPA)) | Fold |
|---|---|---|---|---|
| 517 | 0.10 | 1.08 | −0.98 | 1.97 |
| 1007a | −2.37 | −2.00 | −0.37 | 1.29 |
| 1030a | 0.25 | −0.23 | 0.48 | 1.39 |
| 1042a | 0.89 | 0.51 | 0.38 | 1.30 |
| 104a | 0.10 | 0.95 | −0.85 | 1.80 |
| 1091b | 1.20 | 0.90 | 0.30 | 1.23 |
| 1145a | −0.41 | −0.55 | 0.14 | 1.10 |
| 1184a | 1.48 | 0.94 | 0.55 | 1.46 |
| 1227b | 1.47 | 1.13 | 0.35 | 1.27 |
| 1270a | 0.19 | −1.04 | 1.23 | 2.35 |
| 1339b | −1.91 | 0.09 | −2.00 | 4.00 |
| 134b | 0.83 | 0.16 | 0.66 | 1.58 |
| 1381a | −1.65 | −2.22 | 0.56 | 1.47 |
| 1406a | 0.46 | 0.09 | 0.37 | 1.29 |
| 1469a | 0.77 | 1.36 | −0.59 | 1.51 |
| 1549a | 0.13 | 0.15 | −0.02 | 1.01 |
| 154a | 2.97 | 4.48 | −1.51 | 2.85 |
| 1585b | 0.28 | −0.21 | 0.49 | 1.40 |
| 1598a | 0.19 | −0.09 | 0.27 | 1.21 |
| 1656a | 1.28 | 0.36 | 0.92 | 1.89 |
| 1659a | 0.19 | 0.03 | 0.16 | 1.12 |
| 1670d | 1.52 | 0.68 | 0.84 | 1.79 |
| 1678a | −1.27 | −1.76 | 0.49 | 1.40 |
| 1741a | 0.02 | −0.64 | 0.66 | 1.58 |
| 1895b | 0.89 | 0.42 | 0.46 | 1.38 |
| 1929c | 0.35 | 0.23 | 0.12 | 1.09 |
| 1930a | 0.59 | 0.34 | 0.25 | 1.19 |
| 1981a | −0.04 | −0.30 | 0.27 | 1.21 |
| 2008a | 0.44 | 0.03 | 0.41 | 1.33 |
| 2255a | 0.16 | −0.08 | 0.25 | 1.19 |
| 253b | −0.18 | 0.19 | −0.37 | 1.29 |
| 342a | 0.02 | 0.13 | −0.11 | 1.08 |
| 350b | −0.79 | 0.09 | −0.87 | 1.83 |
| 364a | 0.20 | 0.28 | −0.08 | 1.06 |
| 384c | 0.13 | −0.19 | 0.31 | 1.24 |
| 465b | −0.13 | −0.84 | 0.71 | 1.64 |
| 490c | −0.45 | 0.09 | −0.54 | 1.45 |
| 516c | 0.04 | 1.09 | −1.05 | 2.07 |
| 687a | 1.16 | 0.74 | 0.42 | 1.34 |
| 706b | 0.70 | −0.44 | 1.14 | 2.20 |
| 709a | 0.53 | 0.09 | 0.44 | 1.36 |
| 758b | 0.09 | −0.18 | 0.27 | 1.21 |
| 89c | 0.55 | 1.25 | −0.70 | 1.62 |
| 981a | 1.11 | 0.52 | 0.59 | 1.51 |

The experiments demonstrated that various treatments can affect the expression of OA-associated genes. In some cases, the effect on gene expression was statistically significant ($p<0.05$). In other cases, although the change could not be demonstrated to be statistically significant due to the variability of expression, there was a definite trend for expression to be changed in one direction only (either increased expression or decreased expression). This unidirectional change is considered to be both biologically relevant and significant. In some cases, it is believed that down-regulation of expression of certain genes will have a beneficial biological effect on OA. For other genes, increased expression will have a beneficial biological effect. The invention allows the identification of genes that correlate with beneficial effects as demonstrated by regulation of compounds known to be involved in anti-inflammatory processes, for example. The invention also permits the identification of new compounds which should have beneficial effects based on their regulation of gene expression of the OA-associated genes described in this invention.

The results demonstrate that one can affect the biology of the cells with various treatments and have a direct impact on gene expression of OA-associated genes. The invention permits the rapid and powerful screening of compounds to identify candidate treatments and preventatives of OA in animals, particularly humans.

The disclosures of each patent, patent application, publication and accession number to database sequences cited or described in this document are hereby incorporated herein by reference, in their entirety.

Various modifications of the invention, in addition to those described herein, will be apparent to those skilled in the art from the foregoing description. Such modifications are also intended to fall within the scope of the appended claims.

SEQUENCE LISTING (1611 sequences)

SEQ ID NO: 1 - DNA, 350 bp, dog
agaggcaggaggagctgtgcctggccaggcagtacaggctgatcgttcacaatgggtattgtgacggcagatcagaaccaaacactttgtagcaacgtggagtttcatttgaaaagttcccattaattcatgcagccttcaattgtctcgtatcttaggggtttagtttgccctgctctgtacccctgccctccacaaacatggaatctcagcacacctaaaaatatcggtggggatcagtgaatctgcactcagatgactgtctttcctggagttttctaaggaattgtttcaagcttaggattccagactttgatttattaaaatgtagtcacctgtaaaaaaaaaaa

SEQ ID NO: 2 - DNA, 275 bp, dog
cgactgtggctgtccatcttttctccctcctcaactgtcttcagcgggactccctcttgggtcccccccaccatcacctgaagaccccccacgcgccaagcaccgaatgtcaccttgcccactgtcgcggcccatctgtctggcagtggctggtgtgggcctccacttgacccctttaacatgctgatatttctggcaaaattcattgcttgggttttgtctttaacatttatcgctcgcaatcccaataaagcattcaaatgtaaaaaaaaaaa

SEQ ID NO: 3 - DNA, 1161 bp, dog
tctctgggaaccctggctagatgaagaagctctccataccctaaggaaaggtggcttttattcacagaaagtttcacctaatctgaaacttaggatcatcagtctaaacacaaacttgtactatggcccaaatatcatgacgctgaataagaccgacccagcagatcagtttgaatggctagaaaatacactgaacatctctcagcaaaataatgagaaggtgtacatcatagcccatatcccagtggggtatctgccctattcaggcggcaccatggcaatgagagaattctataatgagaaattgatagagatttttagaaaatacggcgataccattgcaggacaattttatggacacactcacagagatagcattatggttctttctgatacaaaaggaagtccaataaattctttgtttgtggctcctgctgttaccccagtgaagagtgttttacaaaaacagaccaacaatcctggcatcaggctgttccagtatgatcctcatgactataaattactggatatgttgcagtattatttgaacctgacagatgcaaatctaaagggagaatccaattgggagctggaatatgtgctgacacagacctacaacattgaagatttacagccaaaaagtttgtatggactagcaaaacaatttgcaaccccgggcaatgagcagtttatgaaatactacaaatacttctttgtgagttacgacagcagtgtaatttgcgatgggaaatgtaaggcctatcaaatttgtgcaattttgagccttgatcatatttcctacaaagattgcctcagacaacattatataaagcaccatccttaaagtatttcacagtttgtagaaaatgcagcattgttctgtttctgagatcagtttgtgtgaattgttacataaatctttgtgagttagagcgggcaagcaaaattcctagcttggctttcttttttataatcctcaaatgtagatatttgtaacactttaaatctttactacatcgaatatattcaaactgtgccttactagaatgatgtctggatgtgaatatctgatcttccagtttatatgcctaatttatactcttgtacactcttgaaattaccatttatacaataaagcaaatgatttctcaaaaaaaaaaa

SEQ ID NO: 4 - DNA, 323 bp, dog
gagtgctgtagactggccagactccataccccttatgccatctttccttctgaccagagtgatagggttccagccatggggaagcagtccagtcctctgtctccttgcactatcggagacagaagagcccagggcccaagcatcctggcagggatgctgtgggtgtcagttggttccagtctcccacttctggctctgccccagcctgtgtagctgttcctgcatgtggatgctgcatgtcgggtctggggcttggatgccgcactgccccgctgcctgtcccttctagtaaaataaagatctgttatgcctaaaaaaaaaaa

SEQ ID NO: 5 - DNA, 150 bp, dog
cactagcaattagagaaatacaaataaagaccacaaagaaatattgacaaaatgtaaaaagtctgacaatagcaaatgctggggactgtcaatccacaggatctgatttgaatgcaaactggtgaagccagttgagaaagcactttggag

SEQ ID NO: 6 - DNA, 184 bp, dog
acgatgcagagattgctcacaatgtatcctccaagaaccgcaaagccatcgtggaaagagcagcccagctggccatcagagtcaccaatcccaatgccaggctgcgtagcgaagaaaatgaataaacagcttatgtgcgcgtcatatttgtgttaataaaaccataaaactaccaaaaaaaaaa

SEQ ID NO: 7 - DNA, 460 bp, dog
ttgaggtttatgtgtgggtaaaattaggagggcacccttaaaggctctgaatgttagaaacggtgctatgaatttgtgagtgtccaaaatcttttattgttgcagaattttctggtttaggacaacattgtttacaatccattaattagctggaactcaggaacctttttggtatgaagtaatttcctgtgccaaggaatttgacctgtttatcagtatttggggaagttcctggaatgtccgtccttccttctttgccctccctcactgctgtatctctttgtcacatttcttctcttccttcaaatcatagttcccacactgcctgtcatactgggttatcctgattggaattactcttcccaaaaagtatgcacagtgttttactttttctttattatcaggtacgtcatttgtccttttcccctgaattagtgggtatattgaccaaaaaaaaaaa

SEQ ID NO: 8 - DNA, 222 bp, dog
gcctttatcacattgaggacttggagtttcaacatgaattttcaggggacacaaatagtgtctgtcatagtacagactaaataatagatatacatacattgagacagataaagcaaatgtaaaataacaacatttgggcagtctggatgaggatatataggaatttgttaaaacttcatgtaaatctgaaattatttcaaaataaaaagttaaaaaaaaaaa

SEQ ID NO: 9 - DNA, 420 bp, dog
tcatatggttattggggttgtgccattggcaaagccaggcaagctgcaaagacagaaattgaaaaacttcagatgaaagaaatgacctgccgtgatgttgttaaagaagttgcaaaaataatttacatagtacatgatgaagttaaggataaagcttttgaactagagctcagctgggttggtgaaataactaaaggaagacatgaaattgttccaaaagatataagggaagaggcagagaaatacgctaaggaatccttaaaggaagaagatgaatcagatgatgataatatgtaacatttacttcagcatctattttaaatttctactatagtcccatgtaactctttagctctgtggattcttacctacccagagaccagttttcattaaacttttgtcttctaacaaaaaaaaaaa

SEQ ID NO: 10 - DNA, 279 bp, dog
tgagactagaagcatttagtgacctgagcagctgtgggaaggccgtgagatgaggcccaaacgggagaaggggagaggtgagaagaaaaagctttggggcagccccggtggcgcagcggtttagcgccgcctgcagcccggggtgtgatcctggagacgcggaatcgggtcccacgtcgggctccctgcatggagcctgcttctccctctgcctgtgtctctgcctctctcttcgctctctctgaatgaataaataaataaatctttagaaaaaaaaaa

SEQ ID NO: 11 - DNA, 188 bp, dog
ggctgacgagaggagtgatgtggttagtgattactgaatatgtttgattgtaacaactgtttttaagcctttaaacttgtactaatatatagcattttgggttagtcactcattcagcaaatatttagtatatattatgtgctggacactggcctaggtacttggtatacattggtgaaaaaaaaaaa

SEQ ID NO: 12 - DNA, 420 bp, dog
acgatgctgaagacaatgagaagttcaagacaattgtggagtttgagtgccgaggccttgaaccaattgatttccagccccaggcggggtttgctgctgagggtgtggaatcggggacagtcttcagcgatattaatctgcaggagaaggactggacggactatgacgaaaaggctcaggaatctgtgggcatctacgaggtcacccaccagtttgtgaagtgctgaaccttcttcctgcacacttgcctctaagaactgagaagggacaacatgccccaagcagcagagccattgaggctaggccccttgtcccttgtctcccaggagctgtccaggccctcacagcctgcatgctgggctctgtcacagccccccaagcccactaataaagcccctgtttgtgctgcaaaaaaaaaaa

SEQ ID NO: 13 - DNA, 149 bp, dog
tcgaatccaccaggaaaatatagactatatgtaatcaatggtatttcaaatggctctccagtttgaaagatagaaaatttgaactctgccttacaccagacacacatacaaagtacctttgatttaaagaactgaatgaaaaaaaaaaa

SEQ ID NO: 14 - DNA, 183 bp, dog
atgaaggatcacgatcatgacatttctttatgacaaagggctatgtgtaagtaaattatcccctagtttcatgtggtcaaattatctttgttttctaattctactgatctattttcagtagagaaaaaaaacctccctcttccagtcaagaggttatttggctatctccaagaaaaaaaaaaa

SEQ ID NO: 15 - DNA, 262 bp, dog
tgcaccggggagaaagaagccaatgttaactgcttcaactgacagaaactttcacccaaaaaataattttaatacaccagtttccctttctcctactttgaatcaaaccaaaagagaactcttctgttctttctactcctgaactcttagaatgtgccttttgttcatcaactttttttgatgttccatcactacgtaatttacttattataggcgtgatattttaaaaatatatctggcttttaaaatataaaaaaaaaaa

SEQ ID NO: 16 - DNA, 286 bp, dog
aataacggccaggacttaaaactgttatagttgtttttcatattatgcacgaaaactggcacaataatcatgatagaacaactgtccagaaaaaataaaactaaaaaccgtattttactacatttgattatcatacaaaaatatgcacattttgttttgaaacagtattaatagtacctaatcttttttaaatttgtaaattaagaaaattgttaaggagttgaaataaatgtgtgaggagagataattataagaaataaatgctcaacaaccccaaaaaaaaaaa

SEQ ID NO: 17 - DNA, 162 bp, dog
tcaaagatgaagaaactgaggtttggaggttaaggaaacttggcttgcagttagtggaatatgacggaggaaacttttcctttcagaataaaaagaagtatgaaatatttcacacatacttaatagacactacttgtgtttaagagttgctaaaaaaaaaaa

SEQ ID NO: 18 - DNA, 318 bp, dog
aacgaggacattatactaagtgaaataagccagacataaaagacaaatatgttattcctcttctaggagatgctagactaatcaaactcatagaaacagagagtaaaatggtggttatcagagtctgggggaataggaagtggggaattaagtgttgatttggtatggagtttcagtttggggtggtgaaaaggttctggaggtggggtagagtgatgtttgcacagcagtgtgaatgtacttacagctctttagccatatacttaaaagttgacaaaatggtaaattttgttaaataaatattaccaaaaaaaaaaa

SEQ ID NO: 19 - DNA, 270 bp, dog
tcccagccataaatgaaactctttccaaaagcacttgcacaaggcagtctttgaaaccaaaaaacaaaatgaaatttctattagccatgtgactttactcaaattctacaattcttcctgaatttccaatgcatcattgtcagatgaatgctgttttgtgctccagattcactttccacccttgttgcctgtcctcctgggatgctgaggcctagaatacattcacagggagccactgctttcagacttcggatactgcaaaaaaaaaaa

SEQ ID NO: 20 - DNA, 328 bp, dog
cgggtaatagcctggcttcatagctgagagtgccatagtagaggagtgaggagctgagggtcgagccagcacacccacaaccttctctggcccaggcccaacacagggggccctgactggctgcagctgatcggtttcctctatcaaatgctccatctatcactgaagatggagggacacaggagaaatccaggggcctggcctgccagacctagtgatggtcaccaggaagagcaaaacaatgccgggattgttctctccagctatggcggggaaggggcacaagctcctcaataaacttgtctgtctacctcttcaaaaaaaaaaa

SEQ ID NO: 21 - DNA, 257 bp, dog
cgtacgtcatgcaacaccagcagaagcacattaagtcttccagaagaccgtgccttaggaatgctttagaatctgagctttcttttaaagacagacttaataatgtggaatattttctagatatcatttttattaggttgaactgaaaaagtttttgtaaattttttggccccaaattttttaaaacatagttactttggactaggggtacattcttacaaaataaataaacagtttttaaaattgaaaaaaaaaaa

SEQ ID NO: 22 - DNA, 192 bp, dog
agttgctgaggttattagcattttagtgattactaagcacttctgtcagtctttgaaaaaaggacatatgttttgtgctttgaagatctctgaagaatttctcttatattagaatgggcatgtattgtaattgttttatgtcaaatgatatgtgctgtagaaaaaacattaacctttgttcaaaaaaaaaaa

SEQ ID NO: 23 - DNA, 322 bp, dog
ggtgaacagtcagatttatttatattttttttgcaagcattgaataatctaagttttaagtattatttatccccatccgttcgtatttatattaaagaaattctgtaccctgattgttcagaaggtttcttgggccttttgttcaatagtgtattggcgtacatagaaaaaattttttatttgaaagggaaatataattcctttataaaaacgataatgatgcaataataccagagaggatccagcttttgaaaacagtgatttaggtttgtaacatccggcgaaactgaaaaaaaaaatctgtaaacgtgaaaaaaaaaaa

SEQ ID NO: 24 - DNA, 262 bp, dog
atgcccggcagagagatcggactagaaaatgaccagcagtcattacagttttattctgtggaaagtggagactgtctattggtgcgatggtaactgggagtcactggacgtaaaagacttattggaacaattctggcagaaaaagaggttttacagcttgccctaagtacagaagaggtgatatttttcattggaaacagaccatttctaggcttgtatataacagcagtaataaaggctttgcacctactaaaaaaaaaaa

SEQ ID NO: 25 - DNA, 156 bp, dog
atgcccgtcatgaatgataaaagtattcaaaatattaccagtttcatgaatgtaaagatgtattattgagagttagttgaagtgcttataaggaaaagtgtgtaactgagtaatacaaaatactaagagcattgtcatggttcataaaaaaaaaaa

SEQ ID NO: 26 - DNA, 190 bp, dog
gattgcccaagaagtcaaagtaaacatcattcaggaagattatcaaaaatactgccaaaccaaaggaagaagcctgtacacactcctggaggagataagggacctagctctcctggatgtttctaacagttatgtaatgtgaaatactctttttacttcattaaaagagctgttttgtgaaaaaaaaaaa

SEQ ID NO: 27 - DNA, 197 bp, dog
cagcagcaggtgggcaccctcaggcaaggggagtccataaggccgcaagctaggaaatgacccggcacaagatgagcttctgggggcctggaaactccaggaaacatctgcaaaccctgccctacagtggaccctgtaaccggtcgcttgattctcctaaacatgaataaatgaacttacacaccgaaaaaaaaaaa

SEQ ID NO: 28 - DNA, 260 bp, dog
gattgccgccaatttggggggaaaaggcgagatccttattaagtagagtattcactgtttaacatttactattttgttaaatatactgtactttggattttaattattagcccagtcttttcagaggattgtataaaggggtttctcccctcactggtggtgaatgtgtgatgttacattgtaatctttgtgctgtatgggttgagcatcattatatattttatatgtgtacataaatagcaaagtggcaaaaaaaaaaa

SEQ ID NO: 29 - DNA, 244 bp, dog
atgaaggtgggtcagagctgccacttgaacgtgcttagttttcttggagatagactgaacaaagtgtatacgctccccagtcagtgcctctggactgtgctgtccagtacggtagccaggaacctcgtgtagcaattgagcatttgaaacgtggtgtatctgaattgagattttgaagacttagtatttctggatttagacttgatatttccagattttgaagccctcataagaaaaaaaaaaa

SEQ ID NO: 30 - DNA, 124 bp, dog
ccagtgctcaggccactgaatgggaaggaacaaccactgagtggtcttaagccgctcttccacagaaggaacagaatggaaataagcttccagtgcctagccaattgttaattaaaaaaaaaaa

SEQ ID NO: 31 - DNA, 293 bp, dog
ctcaacgccatgatcatcgtgattctgtgggtccgcaagactttgaacgtgatgactgacctgaaaaccctgcaggagaagagaagagaaaggaaaaggaaagaagagtgacgctgggacgcgggtgtgggtgttcctaggggcctctctccttggcattgtccttggagggctcgcgtgtgcgtcctggggccaccttgtcaggcccacccccgcccctcatcatggcgccgtctcacccagcacacgcggaaatcatcctgaaaataaatgctgacgtccaaaaaaaaaaa

SEQ ID NO: 32 - DNA, 208 bp, dog
ggtgaacggctggaaaatgaccccaatatcatcatctgctggaagtgaggctggtgggggctaaactaggcacacgactgtggctgctttcgtcctgcaaagcgctgtctggtgcatgagggctagacccgtagactagtccgtattgtctcaggggtgaccctcagttctgtaaataaaagcatctgtttcaacctaaaaaaaaaaa

SEQ ID NO: 33 - DNA, 174 bp, dog
acggggtgggatttcttttggggatgatgaaaatattttggaattgggtagaggtgatggttgcacaatattgtgaatgtacaaaatgccactgaattcttcactctacagtggtcaattttatgttatgtgaattgtacctcaatttaaaaatagtagtgggaaaaaaaaaaa

SEQ ID NO: 34 - DNA, 273 bp, dog
agtaggcaatggggctgatgtcaatatgaaggtatgaaataaaatcagaatccatactgtagtgtttaggagtttgctgtttaaaacagtatcagtagcaaataccattcagcaataaaaaggaacaaattactgattgacacaggtacacaggtgaatcttaaaaaagccttatacaagaatataaatactagtcccacttatataaggttctagaacaattgaaactccatttatatgggattccagattctacagttggaaaaaaaaaaa

SEQ ID NO: 35 - DNA, 241 bp, dog
gacctttgataacttttatgcctagcaacagactctatggcatgagtctgttagtttaggtaagagagactagcaaacaaaaatctcactttcattctgtgctaggaaatgaagagtattcatatttctgcaactgttaaacaagatgtttaacaatttcttaaaagtcaaagaatatatggtaatagtctcaaatgtgtatgtagcagtatatgagatccatttttgctaaaaaaaaaaa

SEQ ID NO: 36 - DNA, 146 bp, dog
ctttggtgctggtaatgtttcatcatcaggtgctggttacataggtgcattcattttatgactacttatcaagctgtacatttatgatttgtgcatttttctgtatgtataattatagttcaataaaaatgtttactaaaaaaaaa

SEQ ID NO: 37 - DNA, 307 bp, dog
ctttggtatgaacatctagtttgagagcaagcaaaacagtaggcttgtattagtgctttaatggagtactggtaacatttttctttcttgataggaatctgcttatatttagccaggcttctatttcataccctctcccactacaaactttccgtgcagttacctttcatttttaaagcaatttcactgctaaatataaattgtatttgtggggttcatagttatataatgctgaagggaaccactctttcgttaaaaggtgataaaagttaaataaagactgtctccacagtaagaaaaaaaaaaa

SEQ ID NO: 38 - DNA, 231 bp, dog
cattccggggaccattttgatcatcctcactgggcgccacagaggcaagagggtagttttcctgaagcaactgagcagtggcttgctacttgtgactggacctctggccctcaaccgagttcctctgcgtagaacacaccagaaatttgtcattgccacttccaccaaaattgatataagcagtgtgaaaatccccaaacatctcactgatgcttatttcaaaaaaaaaaa

SEQ ID NO: 39 - DNA, 328 bp, dog
ttatccgtgttttatttctaacagtggtgaattccgacatttcatgtcattacaagaagtatccaatgcatgtctttgcttatagagttcacactcaccatttaggtaagaacttcaaactacagcttaaatcataaatatttacctttgtgcttgctaatgctataaatgtaaaatgtgaattatatttgaccttaaatctgtttcaatggaagattttgcatcataccttgaaattctgtatttttttttatcatattgttttcattaaaatacctagcacttggggttctgacaatactcaaattttattttggaaaaaaaaaaa

SEQ ID NO: 40 - DNA, 484 bp, dog
agaggcagggatcaacttcatggtctaccaacccactccttgggaggcagcctcagactcgatgaaacgactacagaatgccatgacagaaggcggtgtggtgctgcaggagcctcggagaatctatgaatgaaatagcattgttccaaacggggaactaggaagctgtgaggtgctacgtccttcagaagagagcatctggaagaagggccagctgggaagttttgtacaatcccgtaacagtgtggaacattactgtagttaagttaactacattactgtagttaacatcactccctcctccccttaggtctgttttcggggttgggtggcggtggttaaatcgaaggctaaattcttcccctctcttggacaggagagaattatctgggaaaagcggttgccaattataattaactttcaaaggacaagttaaatgtttataagttaatgaataaaggcatattatgagcaaaaaaaaaaa

SEQ ID NO: 41 - DNA, 153 bp, dog
cggtcctgttagtcacagttttttcatcttgcttgtatattgattaatagctctcttgcttattgttctatggcaagctggaaaagaatgctttcatcatggtctttccccttctagcatgaggctttctctttcattacctaaaaaaaaaaa

SEQ ID NO: 42 - DNA, 359 bp, dog
tcaaagataaggaacgtaccacaatttcacagcaagtcaaaggaaagaaggtctggataggaattaagaagttactaatgctaattgagatgtcactacagatggatcctgaataccgtgtaagaaaattcttggccctcttaagagaagaaggagctagccccctggactttgaaaatggactctttgcacacacacagtgaccaagggaagtgaccaaggtgaagatggcctgggatcttcactcagcttactcaagatcctggacaaagtgaaatgttccttaccttcaacatgtgctcattctgcatgattagtgcaataaaactcccttccttgtgcttactcaaaaaaaaaaa

SEQ ID NO: 43 - DNA, 153 bp, dog
accaggtgaagagtggggttgtcatgaccttggctatgacgcccagcatttcgaggtggctccctctattctttactttgggcatcatagaaaacgtgtctctgggggattaatcttagagaaaaataaagcctttctgctgaaaaaaaaaaa

SEQ ID NO: 44 - DNA, 186 bp, dog
gttgtgctgggagttctatccagaggaagccatttgcggggaactggaagctctggagatggtccctgtcggttatgtggaagtgaagctcctaattctctggaatgaatatatacatatagaagggataatttaggtcccatacacgtttataaagaatccttgttattttctgaaaaaaaaaaa

SEQ ID NO: 45 - DNA, 144 bp, dog
agttatctataaaaaaacctaaaaaactggaatgctttttttcaaattgatacctaaatatctcagaaatctctaatttgaagaaatcttcccaattgaatgctagaattcttgcataagtcttcttgatgttaaaaaaaaaaa

SEQ ID NO: 46 - DNA, 401 bp, dog
caagaccctggtgaagaactgtatcgtgctcattgacagcacaccgtaccgacagtggtacgagtcccactacgcactgcccctgggacgcaagaagggggccaagctgacgcctgaggaggaagagattttaaataaaaaacgatcaaagaaaatccagaagaagtatgatgaaaggaaaaagaatgccaaaatcagcagtcttctggaggagcagttccaacagggcaagcttcttgcatgcatcgcttcgagaccaggccagtgcggccgggcagatggctatgtgctagagggcaaggagctggagttctatctgaggaaaatcaaagcccggaaaggcaaataaatcttctgtcttcggtcatgtaataaaggtgtttattgttcaaaaaaaaaaa

SEQ ID NO: 47 - DNA, 134 bp, dog
cattccgacatgcagttaaggcatctctttgaattttcttctcttttctatcaatcttatagcagtgacctgcgtatggccaccactgacttggacagttagtaggcacatcactttctagagaaaaaaaaaaa

SEQ ID NO: 48 - DNA, 152 bp, dog
gcaagttgaccacgagaccctgactggtatctttgagactccagtgccctggctgcccaagtaataggtcccatggggttaaatggcaccaaaaaaccaggagacacattaaaactttaagcctgcccttcagaagcagccaaaaaaaaaaa

SEQ ID NO: 49 - DNA, 230 bp, dog
aacgaggcccacaccgaggtccacatcaaaaccatgccggccgccacctaccgcctgctcacaggccaggagcagcccgtgtacctgtgaccggccaccagcacccttgcccccgccccccgtcgtgccttagctccagcggcccagggactccatctgcagggcttcccgggctcgttggcgccgtgttattttctcatgtaaaacattaaatgctttaaaaaaaaaaa

SEQ ID NO: 50 - DNA, 187 bp, dog
tcctggataccataaagtagaaaattctattttgagcatcggtttttttgaaaacgtggctacatggcacaatttcctctcccttatcacttcttgactttgattttttttttaagattttcatagttttaaaacccctgtttttaatttcactgaaaatgtcattagcctctgggaaaaaaaaaaa

SEQ ID NO: 51 - DNA, 113 bp, dog
ttatccgaggtcaaaattggaagtcaggaaaatgaagaaaaagatgatgagcaagatatacaaatggaaggagatgccggagagaaggaggaagacgaacccaaaaaaaaaaa

SEQ ID NO: 52 - DNA, 177 bp, dog
cactagcagtttattggatcttgatagattttgcgtttttagatagatccaaattgtactttatacaatccatttgacagcaggtctgttttggatatgtaagagcaatgacaaaacaacaacaacaaagcaactgaaatgatcaacaatagctacttgctccagtaaaaaaaaaaa

SEQ ID NO: 53 - DNA, 156 bp, dog
aactgaggcacccaggtaggtacccaagagagacaatcttaagcagtttccatgccgggcttggagcccaacacagggctcaatctctcaagtaaatctttagaaaaaaattctctctcctccctctcctctgctctttctttagaaaaaaaaaaa

SEQ ID NO: 54 - DNA, 47 bp, dog
cgacgctgaaaataataaaccgacactctgagttggaaaaaaaaaaa

SEQ ID NO: 55 - DNA, 604 bp, dog
ctatttcatccaaacttttctcattccagacagaaaaaacaaaagtttgaaacattattaattcctttcaggaacaattaaatattcctccttgggaggacataataataaatattaactaaatttagctttctaagtttccaacacaatattaagtgcctttcatttttccactgaatcctcacaacacagacctccttcctcaggatggctctcctagaacctcctgcccacagtaaagatgctagctagtgtctgcaactgcttgcctacttgtcttgacagtcttcagactagaagctgaaaagacagggatctcaatgatcaggtgtctcattcatttcttcttccaacaaatattcctgagcataaatgagacagaaatggtcttggcgtactggggctttcttacaaagtgaccctcaacgttgcttccatgggggtccttccccttgaacatgtccttgcagtggaagtcatgctatggtttgtaaggctagataaaaatgcaatgcacttcaccttgttctcttggagcaggcactcttagaatctagttgtcatgctgtgaggaagcccacaccttgcccatgaaaaaaaaaaa

SEQ ID NO: 56 - DNA, 485 bp, dog
tcaaagaggagagtttatcaaaccaaatgttcagaagactaactttcctttcctagaactggaccggataagacttttcattgggatgttctgagatcagtaattcaaaacttaaaatacacaaaggaattttgaaaatcatgtttcctaaatttcctcaatcatgataatcatctgaaggtatttgtaaaaataaaaatttccacgttactggcccataccaagcctattgtattgattagcagaattaatcttcagtattcccaagtgcttctcatcatggaaatatggataaacactccttcacataatcagttaatttaaaattgtacttaataagtgaacgattaaaaaaaaataagtgaacaattaatggcaaccccactcatttgtaccatggcctgtacattctgagtttggaagataattttgaaatgattgttttccaaataaatatgctatgttttgtttggcaaaaaaaaaaa

SEQ ID NO: 57 - DNA, 121 bp, dog
gtagtaagaggatgtaaatatctatactaggtgaaatactgtcttggttcattctggctgttataagaccatacagtagcctgtatggcttacagagaaagaaatttattaaaaaaaaaaa

SEQ ID NO: 58 - DNA, 801 bp, dog
agaggcaaagagagaagaattagaaacagaaaatcaggtgttaaatagacaaaatgttccatttgaagaatatacaaggcttcaaaaaagactgagggacatacagagaagacataatgaatttcgaagtttaattttggttcctaacatacctccagcagcatccatcaatcctgttagttttcagtcatcaggcacggttccgggcatggacctatcctttcctgctcatatgcaggaggaacagcatcaaagggaactctctctacttcgcaaaagactagaagaactagaaacaacacaaaggaaacaactagaggaacttggatctacgggggaatgatgttcttggagaaaaggcagatcaaaagggatgaaatcagtgtgactcaataaagcttgaagttttaacgtatgtggcatttagatactgtattactgtgtgcctcaagaaaaggtactggctacatgctatgttgcattagtgtcaggattgtaggattatactaatgacaggtcgagcgttaaaacagctccagaaatatttaggatacttattggcaaccctttgagaatgtttaaaaaaaaaaagaaagaaagaaagaaaagaaaaagaatgaactggggaatcaggtttttaaattattttattaatttagctttgaaattttttggtattttgcctgaaatatgcccatgttgaattccttctgcctttttgaggtgcttgttagtaacaggatcagtaaacagtttccagtttacaagagttctaaacctctagttcttgaaaaaaaaaaa

SEQ ID NO: 59 - DNA, 265 bp, dog
caagtttggaaggaaaggtgacctgtctgacccttggcatttggtatctaggtgggcttggtgctcgctttccctgcattgcagtgtcaggatttttctgggatcagccttggcactggagatcttcacattttccatctggttactatggcacacatcgtacagatcttacttacctcgtgtacaggtaactcctttttttcagattcatgaaggacaaagtacttgagttttctgtttaaaagaaaagtaagaaaaaaaaaaa

SEQ ID NO: 60 - DNA, 285 bp, dog
atgcccggaccacagtaaacaagggacagctgaggtggaagacacacaggaatccggggggagccagccagggcgggctgaggtcagccgcccctcagtttcctgtctgtaaaagcagaactgatcatttgaaatgtttacataattcactggcaaactgtgagaaatgaactatatttgtaagcagttttgaagaattttgaagatgaaagggatagtttcaagctttgaggtatggacagcattctaaaaaaataataaatcacttatctctaaaaaaaaaaa

SEQ ID NO: 61 - DNA, 305 bp, dog
ttgaggttgtgatatgtatactgagtttactggcttccagttggggttggagcggtgaagatatcctaattcagtgttcccccagctaactcactaattttccccgttttcctattatatctgcgctgggggataaagagtggcctgagagtgtggaaagagataaataatttttcaagccatggtgacctgagagaaatcctctaggcttatcccaaggtctgtccactctcaaggccatcttctgggagaactgagaaaccagcgctgttcatatagtaaaatgtttcaggtaaaaaaaaaaa

SEQ ID NO: 62 - DNA, 260 bp, dog
gattgcccccttattgccaacttctcctttttctactgtacaagccaccaactcaaccgagagctaaagagacttaaaaaaagagagagaaaaaaaaaaaaaaaaaaaaaaaaaaaagagagagagagagataagctgcaagtcaactgatttgtgaatgagaaactagaagagatttatgtataaagctccctcctttccccagattcaggatgatttcaaccagtaaacttcattgctgttggtgccaaaaaaaaaaa

SEQ ID NO: 63 - DNA, 284 bp, dog
gttgtgcagcagaaacagattctcagttcatttttactcccactgtattatagtttaacaaaaattgtttatatcttggaaaaaagactttctgtttaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagagtctcctggatatataatttattctgttgaaaaaaaaaaa

SEQ ID NO: 64 - DNA, 153 bp, dog
atgcccggccagttgaggcccgtcacgtatcaagactttgaaaatgctttctgcaagattcagcctagcatatctcaaaaagagcttgatatgtatgttgaatggaacaaaatgtttggttgcagtcagtgatgacttctttaaaaaaaaaaa

SEQ ID NO: 65 - DNA, 471 bp, dog
tctctgggccaggtacagtactgagcaaaaaagacaaaaatccttgcctttatggagcttacattctttctctaaatgttagtaagaatttacattctaggagtgatcaactagtgtttaatcagaaagttcacactcccaaagcagctactaaaagccgtcagaagctattcctattacataacagatactcctttaagtaacagatgttagaaatgggccctttttgaaattggtgacatttgatacatgtgaattgcctaaatattttgaagatattccccttacttagaaacaggacatagatctggtaaactttatattctttccctcttagaatggcattgacagtgaaatgtggaactgattttggtagattttaattgcctgttgcccactacaaggtaacagtaatgcctatggggtattgttgcatctgtctggagtgaaccttttatgcaaaaaaaaaaa

SEQ ID NO: 66 - DNA, 218 bp, dog
gttgtgcaatctaggaagttgcatagctgagtgaagtgcttctttaaggaaggagtgagttaaaggcaggtagctggggcgttacctaaatgattatgttgcttcctttgtctgtatgtggattttatagccctttcaatcaaatgagaaaaaagatttgtatattatcaatgtttttagtttaaataaacagtcaccattactactaaaaaaaaaaa

SEQ ID NO: 67 - DNA, 492 bp, dog
tgagactggattaaaatatcaagaaaggaaagagcatacatggagaaatggggagaacaaagaggagcatcacggtatttctgtgggaactcttatgtactgaaggagctgcaggaggacctgcactgaaccaaacaggaaaataacggtctcatgagataagagaattaaggagggtaagttatcaagactaggagtggctgcacacagggatcaaaaagaaggaagattgagaaatagatttaggaatatttgtgatgatgtagtcattaaaaaccttcaggtttgagcatgatagttaccatatgttgctgtggagtaagaggtaggggcaaatatgagctattctttcaagattttggatgatgaagagaggaatagagacagaaagcaaaagaagacttgaatgatggggctcctgggtaggtagattaagaaacaactttagggggaagagaaagtgtaaatggaaagagagtggaaaaaaaaaaa

SEQ ID NO: 68 - DNA, 268 bp, dog
gattgcctaattgtgccatgttagtgtcttgctctaaaactcaacattcccttctccttttgtactgtgttgtgcttgctgtctctctcagacatccttaaagacttgtctttttggcacaaaacacacacacacacacatacacaaaacaaaacaaaaaatttcagtaaggtgttttctgtaatctttttttaaaatatgagaactaattattgtccataacttgtagcattcttcattaaagtcttgcttctctcaaaaaaaaaaa

SEQ ID NO: 69 - DNA, 204 bp, dog
aacgaggtctgaggggcaacacaaatgtcacaaataaaggactacagttttatatgattttgtaagtaaataagagaatgcttttaggcacattcagtgggaggagctgtaggtctgtacgttaccgtgaaaagaaaatgagacttaagaaaaagttatgacctaacagttaggctgagctcaggaattatccaaaaaaaaaaa

SEQ ID NO: 70 - DNA, 443 bp, dog
gacctttaacctacctataaggtgcctatacctgagatttcaggaaatacttgttgaccaaagaaatgtgaatatattggtcaagctggttggagtaagtatgcaaactgcctggcaattatacttttcattgtaaatgaatataaaggtattacagctttatgtatcagtctcttacgagctttgttagcaatcagtgctgataaacataatcatttctggaaccgtagtgaggttgacttttggacacaagagatttgaaaggcagtcataaattcgcagaggtaaatgtcattccttaattcccagaggaatcatcttttttgatgattgcttttccattgttagtttttaaaaattttaagtaaatatatgatagctttagatttttgttgtttctgctttacagttgcaaaaaagtactgcccacctaaaaaaaaaaa

SEQ ID NO: 71 - DNA, 182 bp, dog
gttggtagcaatggtttgcattagtttctgtttccacgccagggtctgtgtgggcgggtgcaccaagatgcgcaccgaggggactctcaatcacaggatttcatatgttgtcattgtcacactttcacatttttgtacatcagtgaattttttatattaaaaggttgagccaaaaaaaaaaa

SEQ ID NO: 72 - DNA, 172 bp, dog
gagtgctcaatgaagtgtccagcagtgtctgacacccgccacgcggtcactgtaggcattcagaagcccctcacactacagtaaaacagctctgagacgcacaaagcatttgctggtcacatggtggctccaatgcaagcaaaatacagtttattcgttccaaaaaaaaaaa

SEQ ID NO: 73 - DNA, 186 bp, dog
tatttatgagtgtatcccttattttagtgactataaagtatgatggttaaaagccagaattctagctcttttacttgctatccatctgacttaagtgtgcctcagtttcctcacctgtaaaatggagatgatgaaaggctctatctcataaagttattgtgagtttggatgagtgaaaaaaaaaaa

SEQ ID NO: 74 - DNA, 292 bp, dog
tgaattcaacagagaacacatttccatccttgtactgaagtcttgtggtccacctggaacagccagacaagtagctcttctaagttcacagtctcttagaccttttctactactacttttagagtaaccttctctagggaataatattttttgtataattcataaatctctaatcaaggacaaggctaatacagtcataaatctgttttctgaactctccttcacatgaataattgccaacccattaaggaatattctaacataataaaagtaatttctgcaaaaaaaaaaa

SEQ ID NO: 75 - DNA, 319 bp, dog
gtagtaagccacccaagaatctctaattggttagtgtaaattgtaaatacccaaagggtggaggagaaaagtatttaataagcattgattcccaaagttatttaactattggaaacctgtttttttcttccatagatttctcaagagatagtgccctctagaaaaacttgaaggaaatgctgttttacaatcacattccatttataggtgacaaatcagaggctcagggcagcccagcaagattagtttctatttttgttggagatcccttgatactaacacaaaagtgaaggtttgtcttaccaattaaaaaaaaaaa

SEQ ID NO: 76 - DNA, 348 bp, dog
ttatccgtgtggttatttgacaagatttcagcttgaagcctcaaccatgaattgatttttgtttgtttgtgtgtttgttttgggccaattttagattcctgagtgcacttttctttttttccagttagtcctagcttttaaagaagaaaaaccaagagacagatctggtgtaaatgttgcaatatgaattgtgtttgcaacccattgccccccactgccccccatttgggtacactgcacaaataaaatgctagggagttcggggaaagaaaaaccattttttctaacttgttgctcatttgttgtaactcaataaagcaaagactaaacatttttataaaaaaaaaa

SEQ ID NO: 77 - DNA, 308 bp, dog
aacgaggaaccagagcttctgcccaactgtcaaccttgataaactgtggaccttagtcagtgagcagacacgggtaaatgctgccaaaaacaagactggagctgctcctattatcgatgtggtgcgatcgggctactacaaagttttgggaaagggaaagctcccaaaacagcctgtcatcgtgaaggccaaattcttcagtagaagagctgaggagaagataaagggtgtggggggcgcctgcgttctagtagcttgaagccacatagggggaggttcattaaatgctaacaagtgcaaaaaaaaaa

SEQ ID NO: 78 - DNA, 224 bp, dog
gtagtaagaattaaatacgtttgtttttaggggggcctgggtggctcagtcagttgagtgtctgactcttgattttggctcaggtcttgatctcagggtcgtgggatcaagccctgcatcaggctctgcactgaatgtggagcccacttgagattctctctctccccctccccctgcccactccccaagtagcatgtgccctcgctctctcttaaaaaaaaaaa

SEQ ID NO: 79 - DNA, 177 bp, dog
tatttatcagagctccaaattggaaataatccagatgtcctttaacaaataaagggataaacaaactgtggtatatccatataatgggatactattcatcagtaagaaggaataaattattgatacatacaacaattttggatgatgctcaaagacatgttaagtgaaaaaaaaaaa

SEQ ID NO: 80 - DNA, 478 bp, dog
tgaattcctcaacatgtagagagatttttgtttgtttgttgatttggggttttgtgactttttgatgtatatcaatagcattgtctttgtaaataaaggattatggtctctttgtgaaaccttattcatcctggcatttgccagaaacagagaggaacacaagagaaaggagaggaatgcacatatatacctttcctcgttttccttccctcagaaataaggaaaaatctaataaactggctttcataaaatgaagttgccatattaatctcaggaagtagagatcagagaataccaaagctgtgaaaacattgtaaagattagaaaaattattaaaggaaaactcataaaacaagcaatttaatattggattcgtttcttgggtagaatgccttccaggtaaatgtaatggagctgagaagtattagcaattcctcttcacacctttacaaatcataccagttgtcaaaaaaaaaaa

SEQ ID NO: 81 - DNA, 185 bp, dog
ccagtgcagttccaagcaaatagttgaactattcacctctgaagtcctcataatcagctttgtcttaaacagtcttcaaagacaccaaaagagactgtaacttgcagacaccagtagttaagaccattgaagaaattatttcctaccaaataaagctctcctgtttcaaaactggaaaaaaaaaa

SEQ ID NO: 82 - DNA, 286 bp, dog
cgaaatgttaaataagttgtgcaatatgcccaaagtaatttgtttctaaaaataagatgatttatagtaccatgttttcaaatgatttacttttaaaattaatttttaaattatatatgattgtagatgatcccagtaatcctaccattgttgcttatttgtggtttttttttgccttcattggtaagaggtggagttacatatgcaaagagtatttaggtgtatacaaaagtgagttttttttatataaatgccacctctttggtttttatcagaaaaaaaaaaa

SEQ ID NO: 83 - DNA, 236 bp, dog
ggctatgcaaatgtttgttttgcttaatgttctccatttacacttctcagcaaatgtagttgcagacaaatgctttttttttattttttccttggtttggggtatgtaaatagcctaaaatgtacattgaatttcacattgtaaaagttttattttattccttgtattatattaagcaaaaatccctatgtatatgaaagtgcataataaatatatttgctctacaaaaaaaaaaa

SEQ ID NO: 84 - DNA, 210 bp, dog
ggagcttgggttaagcaatgcggggagggaaacaaaacacaaaagtaaacccaccaaaaatgcagggagtggttgtggaacccccctgctttaaaatgatgtcaatgaatacttacttggtagcaatgtgagaaactaaatattgaagaataaatttgttgttgttgtttttaagagaataaattggatgttaatgctcaaaaaaaaaaa

SEQ ID NO: 85 - DNA, 259 bp, dog
gcaagttcagacagttttgcatctactcagcccactcattcatggaaagtaggagacaagtgtatggcaatctggagtgaagacggacagtgttatgaagcggagatcgaggagatagatgaagaaaacggcactgctgcaatcacctttgctggctacggcaatgctgaagtgaccccactgttgaacctcaagcctgtagaagaaggaaggaaggcaaaggaggacagtggcaacaaacccatgtcaaaaaaaaaaa

SEQ ID NO: 86 - DNA, 396 bp, dog
cagggcagcggtgtgagcttaatagggttagaggaaaaacaggaacagtttggagactttctttacaggcaagtagatcatgcattcattctgttgttcagcaacaacttctcaagcccgaatgcgcccagcaccacgctggcactgcggctataccggagaaccgaaataatccctttctcatggtgtcacctcagtctggagcctgctcttaaatggatcagcacatgttgcaagaagtgtgatcacagtgaaaagcgacattaggtgagaagagcaaggtgttggtggggagatccttcttgagcttgggtggtcggggagatttgaggctgttaagctgagatctgctggaaaagaagttgctggttaggtggctcatgggaaaaaaaaaaa

SEQ ID NO: 87 - DNA, 175 bp, dog
cgaaatgggattctgtgacaggcagctgaacctcaggctgctgaagaagcacaattataacatcttacaggttgtgacagaactgcttcaggtcaacaacaatgactggtacagccaccgctactgaggagtggccttgtattaaatcactttgcctgctgctcaaaaaaaaaaa

SEQ ID NO: 88 - DNA, 131 bp, dog
cggtcctacaccaccgaggaggttgagcaagtacagatccctgggccagcccctagggcactttcctcatcaggtcaagcagggactgggaatttgtacattaaggaagcccccccccccaaaaaaaaaaa

SEQ ID NO: 89 - DNA, 352 bp, dog
agttgctataaaatggaacagaaacaggtattcttcttagtctttattaatggttaaagttcttctcaggaagtctttcatattataactgttcattatctttcttttatagtatcatttccctttttgtagagtgaaaattggagtagctactaaatatattaaggttaatcctccagaaatggactgggagacattttagtcacaacaacttacatttggttttggaagttgttaacaaagcataattgatgtttttaaatcaaacaaactgagtataactacgatttgtatcttgaaacttatgttttggcatttgaataaaacagaagtactaaatgaaaaaaaaaaa

SEQ ID NO: 90 - DNA, 297 bp, dog
tggtcaggatggggcaaggaaattatctttgttccagaagtgcaactgatgcctcttgacatctctaagggttattattatcatgggtgccattttgagaagaggccagtaataagtggaagggtacatctccatggaccaagtggcatcaggagcctaggggcctgtggcttggcaaaaatagaaatcctggttgtcacagctgtgctttgtgattcaagctcaccttccctccctttgtcaaagcacttaaccctcttaaactaggaacagtctattcatttgcaaaaaaaaaaa

SEQ ID NO: 91 - DNA, 163 bp, dog
acggggtgggggtaagaggggtttctgatgctagttcttgatctaagtgctggccacatgggtaattttgtgaaaatgtattaaggttaacatttaaaatttttaaacatttctgaaggtttgccatataccagggcaccatttactcctagaaaaaaaaaaa

SEQ ID NO: 92 - DNA, 290 bp, dog
agcagcacaacacacactgttcacacctgacacgttcactcacacaggcttcacccagagccacagaataaatctcaaagaatctcaaagaatttaagttacataaaagtattccctgggggcacctaagtggctcagtccattaggcgtctgccttcaactcaggtcatgatcctaggatcctgggatcaagtcccatgtagggccctctgctcagcagggagcctgcttctccctctgcccctccccctgcttatgcgcacgcatgcgctctctctcaaaaaaaaaaa

SEQ ID NO: 93 - DNA, 267 bp, dog
gcggtgaaacaaagaataactgcatgtttaagtgatcagagtcacatacacatatcgttgcattaacagtgagtttgcactaaatggggcacagctgcaaaagagactgtcaggaagacacagcacatcaggtccccacaggataatgaagcccttttatagtgtttgccttgagaaatgaacgtcactcaccctgatccgagaaggctgggagcatctcagcaccttaaatcatgagagcaaaaaatcactacttaaaaaaaaaaa

SEQ ID NO: 94 - DNA, 307 bp, dog
agttgctaaggaaacagaaaaggctgccagtggttgtaccagggatcaatgatcaagagactacttcatggaggatatagcagttgggggtggtatgagattatactttgtgttttttaaataatttttttcttaaggatttagcatagtataaagaaaaggagatgcctacagatatttggagcatattttcatttggggttgtgtgttttaatgtgtaaagaatacaagtccttcttaatggtaaaatttgtgattgtgacaaaaggaataaaatgagcaatatttaatttggtaaaaaaaaaaa

SEQ ID NO: 95 - DNA, 101 bp, dog
attcttctgtcggggtaatccaggttttggaagtattgggaaagctcctggctgtggtaaaacccaatataactaattaatcctctctttaaaaaaaaaaa

SEQ ID NO: 96 - DNA, 124 bp, dog
aaatcgacaaaaacagatctacaccaagacatattataattacaatgaaaaacatggtgataaagaaaaaaaaatttaagcagcaaggcaaaagaagacagttacatatagggaaaaaaaaaaa

SEQ ID NO: 97 - DNA, 58 bp, dog
aaatcgaccataaaagaccaaaaaaataaatcagaaaacccccacctaaaaaaaaaaa

SEQ ID NO: 98 - DNA, 245 bp, dog
cgaaatgaagaaattatggcacgagacggccatgccacttacttgagattcattattatatcagcctttgatcactttgcatctgtgcatagtgtttctgcagagggaataacagtctcaagtcttccttagtaattagaacagaatactcttacatgatttttttaacaatatatttatttaaacatgaagttgtcattgatatactttattaaagagatttgtatcaatctgaaaaaaaaaaa

SEQ ID NO: 99 - DNA, 301 bp, dog
gtagtaattaatgttgtaaacatacatggagacttcagttattcacttccatttaatagttctgcattataccagaaagacttgaaaagtagtatttagaactctttgttttttcatagtatattttgagtactattttcatagatttcatttaaccatggactgttttctgttgaaactttttactttaatcatctactgtccaagtaaaaataaaaatcagaattctgatatttcttttgcaaattggatttcaaattcatatattatgactacactgctaattccttaaaaaaaaaaa

SEQ ID NO: 100 - DNA, 307 bp, dog
aaatcgagagttcgacgcttgacctactgaggcaccctgccacaacctaattcttcagtttttaaagtatgatatgattgtatgatgtcttgaaaatagtttcacaaatgtggagagttagcagaaaaaatgtcttcgctgtgatgacaggtccaacaaggaaaagataggaatttgaaaaaagaaaatgtgtcacgcctggagtttttaagagctatctattgaaaagttttatttaatagcctctctgatattattttcataaaaatgcttaaataaaaatacaatgtaggtataaaaaaaaaaa

SEQ ID NO: 101 - DNA, 147 bp, dog
acggggtatggttctggggggaaggctatgggaggggctgggtgccctctggagagaggtgctgctgtctctggctgggaaatccatcctctgggcttagcagtgccaatcacaataaatttatataatcacactgaaaaaaaaaaa

SEQ ID NO: 102 - DNA, 268 bp, dog
gagtgctgatcaggtaaccaaagccgtggagaatgtgctaagtggcaaagcctgaagcctccactgattgttaagagcaacaacagccccacaacttgggctttgttggactgagtaaaatgtgaaaaaatgtgttctgttcttgtgccgaagaatgctatctctggatgttcttatactcgttttacccttcaacccttaacctgcaaccactgaggcaaaacagtttaatataaaaataaaactttattctgtccaaaaaaaaaaa

SEQ ID NO: 103 - DNA, 185 bp, dog
accaggtggaggaaggagtcaatactgtacattgtctcaatgcctgttttttatgttttcctttcactaagggtttttagtttgggtttatttttggttgggttggcactaatccttttcttaagatgctgtgagaaccatttcattcaaatgccaaataaatttgtgttctggaaaaaaaaaaa

SEQ ID NO: 104 - DNA, 270 bp, dog
gagtgctgatcaggtaaccaaagccgtggagaatgtgctaagtggcaaagcctgaagcctccactgattgttaagagcaacaacagccccacaacttgggctttgttggactgagtaaaatgtgaaaaaatgtgttctgttcttgtgccgaagaatgctatctctggatgtttttatactcgttttacccttcaacccttaacctgcaaccactgaggcaaaacagtttaatataaaaataaaactttattctgtcccaaaaaaaaaaaa

SEQ ID NO: 105 - DNA, 202 bp, dog
ggtgaacaatatcaaatctttatttaacccatttttcaagaaaccagcagaatgatataggtgctttaaaaaacatttatatagccttcattatgtgggtactggggttggggaaaagcatgcagaaatgagcttgtttatgtacaaacttggttattgacctgtagaacaataaacatgtaaacttacctaaaaaaaaaaa

SEQ ID NO: 106 - DNA, 408 bp, dog
gattgccaaacagtaagtcattccaggctactagaaagagtagatggaccagaatctgtgaatttggaaatgggccacagaaaaagcctccatttgaggccaatgttgacaattatctgagtatgttttaaaatacacaattaaaagttaatgtttgaagccaatgaattgtttattctaacttgaaacaagacttcagtgagaataaaaggagagctactttattttaaaactttgacataaaaataaatgctaaagcttaacatgaacctgtctgcatttttactgagacaagtgtcactcttgggtttttattatgtgtacacatggccacatgtttatgtaaaatttgcagatgtttgatgtttcaatttgcaataaagctattatatctttcaaaaaaaaaaa

SEQ ID NO: 107 - DNA, 551 bp, dog
tttttttttttaaagtggagtggaagcctttgcttccacctttgtgtttttaacccagaatttctgaaatagagaatttaggaacacatcaagtaataaatatacagaaaatatacttttttataaagcacataagtgcgtatgctattgtgttgggttggtttcctcttttttccacggacagtgttgtgtttctgttgatagggaaactccaaagaatttgcacacctccactccggagctgagatttcttttacatagatgacctcgcttcaaatatgttaccttacgggataggatcttttcttgtagcactataccttgtgggaactttctttctttctctctctctctctctcttttttttaacgtacacctaatttgagaagctgaagaagaaaaaattttgaagcactcactttgaggagtacaggtaatgttctcaaaaattgcacaaaagaaaaatgaatgtcgagatgattcattcagtgttcgaaagacatggatctgttgaaacaatgagtttaataccttgtttgtaaaaaaaaaaa

SEQ ID NO: 108 - DNA, 122 bp, dog
ctatttcccttgaaggtttaaataagttcaaccatattctgtcaactgttccagttttcagtggaatcttgtatttctggttgatcataacaagaaatcgttctcaaatctaaaaaaaaaaa

SEQ ID NO: 109 - DNA, 223 bp, dog
ctcaacgttaattccagaggtggaacatttttttttcctagtaagaaagtaacccatttaaggagaaaacgattaaagagaagcaccagagagcagattcagccgaagcatatcccagtttgatcaactgcagtttgaaaagccgaggcctagatcagggatcaacaaacaaggacacactgcagtgtcagtcagccctgttcgtgacaattaaaaaaaaaaa

SEQ ID NO: 110 - DNA, 144 bp, dog
gctgctccctcgagtggtagcgcctggagcccaagcgcatcagtgcacttccaaagtctgggcaacagaatttaatgggaattttcaaatccccaaaattgctctattactgttgcctatcctcccccccgccaaaaaaaaaaa

SEQ ID NO: 111 - DNA, 171 bp, dog
gttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacgcaggcaaaaaaaaaaa

SEQ ID NO: 112 - DNA, 129 bp, dog
cagcagcagcatggggagcttgctagagacgcagaagcccgggcccatccccagatctactgaatcggtctctatttttacagaaccctcaggtgattcaggggacattaatgcttgcaaaaaaaaaaa

SEQ ID NO: 113 - DNA, 729 bp, dog
ttttttttttagtgcaaatggcaaaaacatccccatggcattagctggccacaggttattcagtgtactgtacacctctattcaccacgtcctatttctggcctgctgcctgcaggatatgaacaaaaaatagggctctagaatgtggcacttggttgaaactggcctacctgcatatataataaattccatagtgactcagacccgaggcaatattttctaaaatgagaggtttcgttcatttacttcctacttctgctactggatctgatatcttctaaaatgtaaggaaccagttactattaatgataaccatctgctcattataaatgtgaggtctaacaaataagtaatacatgctatatttattcaagtgtctattgcttaattgttaattatgagcaggtcattgaacacctactcttattttctgcagtttactgtacagtaactctttgagtaaatcgattaattgtgcaacaaatttatattaggatacaatttaaagtgttttactctatagcctttttgacggggggaagcaaagggcggtgttgattagtacattttgtcttgtactagctctgtttctataagatgcggtgccctgtgtatcccagagagttagaaaactttgttctttgctcctgtttgtgggttcagtttttgtgggttttttttgagaatatacatacacaataaaatgttccttgcttgttaaaaaaaaaa

SEQ ID NO: 114 - DNA, 432 bp, dog
tcaaagaataaagtaaaaggtgattttctgcctaatttatctttttcaaaagtcatggtattttcttctcctataaatgagaagaaaaaaggctgatccagacttggaaataaaaagcaattgttgtaatattttcccttcttagtaaatagtaaatagctttgcacaagaaatacctgtcttagtggatgaagcctgttttccttgaacaactttggaaaatggatttgacagtacataatcagttctactaaccaaagctttatttggaaatttccttttttgtacaaattgaattatataatgcttgaaatactttaagtcactttataagcaaaatgcatagcacttactttgtttatactgtaaagtatatgttaaatgcttttattaatttgagaataaagatagttactaatgcaaaaaaaaaaa

SEQ ID NO: 115 - DNA, 425 bp, dog
tctctggtattgctagtctgctaagaagttttaataagtcttttaataagaactactttcaagtcaagttttattcttagtaaatgctggtctctctgtttgcttttattcttgtgccatagaatgttaaatacagtggctaaaagcctggggaatatagagaagctgctccttcttaccagacctggaacttcatttgttacatcctcagtattttgagattgttgaaaactgtacagactgtccatgatatctcagtcatttcactgtgattttcttttggacttcttcaattcttgttctatcaccaaattgaacatatctaggggaaacacaaaaactaatttcaggtttatatcaatgtagttccttcttttggcagatatcttgactccctcaaatcttgaacatttgaaaaaaaaaaa

SEQ ID NO: 116 - DNA, 167 bp, dog
tgcaccgccatactccttgacctccctggtgctagacctctgctcgtgccattccccctggctggcatgcccatcttcccccagcccagtgaatccctcctcctctttcaacaactcatgggtcaccttctttgagaggactaccctgacagccccaaaaaaaaaaa

SEQ ID NO: 117 - DNA, 402 bp, dog
ttgaggttaaaaaagcagttttccgagattgaccgagtatgcttcatttgtacataaacacgctcaagaaccatagcgatattagaggtttcagagtgttgtatacattgaacaaatgcacacattgtatccgaagatattatttattcaacatttgtcatgcattccaataagtaaaaatcacatgtgcatagaaagcacttcccttggaatcaacagtcagagattcttgtcttcttctgagaagagacttggcaagagaaaagagtatctgaagcgttcaatgccattcaagttcagatactgaataaacttgctgtcagtcaaaagtcagatacattagaaaaaaaaaaaaaacagcttgtaagtaaacatcaattcagttaggctggaaaaaaaaaa

SEQ ID NO: 118 - DNA, 162 bp, dog
atgcccgctcaggaatgaagattgggcggattgaggatgtcacccccatcccctccgatagcacccgcaggaagggaggtcgccgtggtcgccgtctgtgaacaggattcttcaaactattttctgttaataaattgcctttgtgtaagctaaaaaaaaaaa

SEQ ID NO: 119 - DNA, 176 bp, dog
cgacgctgtgtgggtccccaatgtacatggctcctgaggttattatgtctcaacattatgatgctaaggcagacctgtggagcataggaacagtggtatatcaatgcctagttggaaaaccacctcttcaggccaatagtcctcaagacctaaggatgttttatgaaaaaaaaaaa

SEQ ID NO: 120 - DNA, 251 bp, dog
tggtcagccaggatgcagattttgagagctgtgtgtatatgtataatcatgtttgtatttttcctcaatgttaccagttaaatgcttttgtttaagatagtttcttttggaggtgggttaagattgtatataattgggggaaaagttatatgtacttaaaagtatgtcaagttcttattaggtctctgtactgaaggttcaatttttttttaaagttcacttttcacctactctttgtgcaaaaaaaaaaa

SEQ ID NO: 121 - DNA, 421 bp, dog
gttgtgctaatgtaaaattgtcacataattagttttttgaagatggtaaacttaaggaattgcatgttattctgaaatgcaggcttttagaatgtttttctttcaaaacaggctgatttttcttttcctgaagtccaagtttccgctcctctttaaaattcccgttgtcagttatttttctggtttaaatttctcttatatttccacctgtaatgtcagtggcaacatcatacttgttaatttactttacccttattatacaagcaaattgagttgaactgaatcttccttgtcctagtaacattgtataaagtggcttctctgtacaaaaggttgtaatgcctcctgatggatataattttgtgattgtatttaagattaaaagttgaataaatcacaccagcttcctgaaaaaaaaaaa

SEQ ID NO: 122 - DNA, 290 bp, dog
ggtgaacctatatatggggtgaaatgtggcaatgcaggagatgtccccatggctttctgtgtcacatcttcccagcaggccattgctagtgggagcaggagagggggctttgaggggcactgaatctgggagtgtacttgaggtgttcctatgggggtgggcaggagtgactcacagaaacattcttcatgaccctactgggaccatccttctccagacctcagcagcctgaaaatacaagccaaattttattcatttgttcagttctttcctttttccaaaaaaaaaaa

SEQ ID NO: 123 - DNA, 600 bp, dog
cgggtaattactgaatcaagggctgatcctctcacggaggcgtctcatgttaacctgcctaccatcgctccgtgtaagacagactctcctctgcactcatggacattgccatctcttgcaccaaggaaggccagtagtgagtctgatgtggtagacgctcgcatgggaagatgggaagtattgtgcgtgcatggcattccctgtgaacacccttggcaagtcaggcctgatctctgcttgtacagagatcctcaagagcgtgaaaaggaagagatgtctgttgccgaaaaggctgtgaccaacaagggggttcagggtgaatgctctgctccagctcctgacttcaccgctacccaacctgaagttgcaggctggtctgaaggtgtgcacgtggcctctgtgtctcttcagcagttccctgctgaagactggcacactcagcctgcccctgaagactggtctgcagcctccacttctcaggccactattgaataggtagaaagacccaccgagtggtcttaaagtgctcttccacaaaggcagacaaaatggaaataaagttgatggaaaataaacggtttctaaaagttgaaaaaaaaa

SEQ ID NO: 124 - DNA, 333 bp, dog
gattgccagatgtaaagaaaattttctttctccaaaataatgtcaacgtatactgaatattggtggttaattagttttgttttgtgtagtttgacattttgatgatttactatgttttccatttgtattgtacataaaatttcctaggaatgcactttttttcaaagtgtaggtttgtggatagattttagcatgatgaaactgtcattacggtgaatgtttgctccatgagaaaataaactaaatgtagttagtgtattaatatttaattggatattgaggaaatcatttgccaggcaaaataaaacatgttgaattccccaaaaaaaaaaa

SEQ ID NO: 125 - DNA, 326 bp, dog
ccgacaactcagtatatcaagacaagtaaaggggtagttgggtgcctcagtaagttaagcatctgctttctgctcaggtcaagatcccaggacactgggatggagcctccagtcaggttttctactcagcggggagcctgcttctcccccctctgcctctctctctcatgaataaataaatagcactttattgtgtagtatgcatttaattttaccttagcctgatcaagtttaataaacctatcaccaaatagtttccaaaaaaaatctcaaatccttcatgaaaatcttctttcagaatctcattttatcagtaaggaccaaag

SEQ ID NO: 126 - DNA, 245 bp, dog
cgactgtattatagtttaacaaaaattgtttatatcttggaaaaaaaactttctgtttaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagagtctcctggatatataatttattctgttgaaaaaaaaaaa

SEQ ID NO: 127 - DNA, 235 bp, dog
gattgccttagacctaaattaagaccagcccctgaattgaggtaaagggacaaagaatatactgattggcctaggccagtcctgggccattcacagagctgggaaacctcatatctacaaccaatgaggcatagaaaccactttcactatacctcataacaatttcacattataagaagtgctaatggcaacttttctttcacttaataatagaaataagatggaaaaaaaaaaa

SEQ ID NO: 128 - DNA, 312 bp, dog
tcaaagattgaattttatccaccaaatagtgttcacttgcctgaaatcccaaggctctccatctcccttgagaaattcaattctagatattgccaaaatctgggttatatttataggtagatgagttatcaaaaaaaaaaaaaaacaccacaaacactggattatattcagattcagatagctcatttatttttattttacttcatttttattaatttgaaatgctagtgttttaagttaagtggaatgaacccattgaatgcttacctgctatcaaacaggaaactcaaggtaccttagtaaaaaaaaaaa

SEQ ID NO: 129 - DNA, 211 bp, dog
ttatccggcatcatttaaataggaaaaaattaatgttggcaaaacacaaaaacaaatacggcatgacatgaaaatacaatcttatgtttacaccggcttttcactaacatgtacctaagaagatggagaaatccattcagataatgaaattctgtttcatctagggaagttaacaggaataaatgtatggacccccccccaaaaaaaaaaa

SEQ ID NO: 130 - DNA, 159 bp, dog
gttggtatggggaaatttgcctcccaaaagtgaaacagctgaccagaatccctttattagtctataggaatctcgaaaggaatagagtctcttgtactctgatcaggttctgtgagcttgggaatcttctaagtaaatcttcatagtttaaaaaaaaaa

SEQ ID NO: 131 - DNA, 133 bp, dog
agttatccagaaaagttgtattaatcttcttatgagagtgtctctgtttcctcaaatcttgaccatcactggacatcatattttgaatatttgccaatgtaataggtaaaatgtatctttttgaaaaaaaaaa

SEQ ID NO: 132 - DNA, 285 bp, dog
cgggtaaccaagaagaaaaagaaaaaacgacacaggattccaacaaatgatgagttattatatgatcctgaaaaagataacagagatcaggcctgggttgatgcacaaagaagaggctaccatggttttggaatacagagaccatatcaacaacagcagcctgttccaaatagtgatgctgtcttgaattgccctgcctgcatgaccacactatgtcttgattgccaaagttctgaagatgaagtggatgtgcttttacatggaactcctgaccaaaaaaaaaaa

SEQ ID NO: 133 - DNA, 301 bp, dog
cggtcctgtgaagttggtataactaatatcattcctcttataaaggtagagaaccaaggttcagaaatacagagaaccatgcttgtgacacgtagcaaggcaacagtggagcccagatgccctaactcccaatctcatggtctttctctaaatcttctgtcatgctgagattcaaaaggtccatggtaataatttgataatcagcatatttcagtatttctgtttgtttcctagtattcctttttgagctaaagttttagggaaaacaatttgatatgcttcgattttgtaaaaaaaaaaa

SEQ ID NO: 134 - DNA, 441 bp, dog
gcctttaatttatcacattacctttgcttttctttttatttaaatccacatttaaaaagtcattttaaaattcaaattatacatgcacatggaaataagctcaaatggtatagaagagcataaaaatgaaaactctccttccttctgtcccatgccaatttctacctctagtttttaaagtacttcttgagcatgtagaagacattttatgcatgaacagtatatatgtgcattattttaaataatgaaattatgctaatatatattgttcatcacattgttttaaaatttctattttaactagagaaattatcataatatgtgtatataaaagttaattctaaccccaaccaacatttaccatctctctaaggtatgcagtgttaacattcctcatgatgtcttaccttaattaaaatactatttttcgaaaaaaaaaaa

SEQ ID NO: 135 - DNA, 282 bp, dog
cagggcaaagaaaagggtttcataagagcgcttaataaagttttaggtacatgaatacagcatggcttgaaaggccagaaaacatgagctaagacacatgtgtggtagagtctttcccctgtatcttcaagcatggtacaaatagacaccattccactccaagtcacttctataagtttctggaaaatgtctgaatagaaagtaaaaggtatatatgtgaatactgggtaacagatttgaaaaagttcatccaatctatatgtcgtcttggaaaaaaaaaaa

SEQ ID NO: 136 - DNA, 304 bp, dog
gcggtgacaggtgggtttcagaatacatggtgtcaaaaagtaatggaaattaccttttgttcgagtaatacatcctccttaaaacaaaagtctatttctcaaggaaaaaataaacaggaaaaggggttgttaacaaagaaaactgcaggcagatattctatattgtattttgaaattaaataatttagctgaaggcaaagaacatgatctatttcaaatagaaaaaaaagaaattattttgaaatgtgcttgaatgtgagaactgattagagcaaaattaattagactatgttaaaaaaaaaaa

SEQ ID NO: 137 - DNA, 199 bp, dog
aaatcgatgtaggatctcttctatccaaattgcttcaaaatatccttatttctaacttagtaattctttccagtgtatccattttttatatcgtggttgacccagtaagggaaagattagaaaataagtagccaaatccaagcataaggtgatgaagatttgtatttaagtgttagagaaagtggattaaaaaaaaaaa

SEQ ID NO: 138 - DNA, 237 bp, dog
acgatgccaggtgcaatctactggaaatgtagcacttcgcgtgaaatatttgttttcccccctgttttaatatgaaccgatcaggagtaccaaataaatctcccaattaaagattattgtgacttcactgtatataaacagatttttatactttattgaaagaggacacctgtacattcttccatcatcactgtaaagacaaataaatgattatattcacagacagaaaaaaaaaaa

SEQ ID NO: 139 - DNA, 134 bp, dog
aactgaggccacaaagatagtgtttagaatccaacaatacttgaatttgcatattcctaagatctttatctttctatttatgtcttataatactatagttggcaactatgttatcttatgtctaaaaaaaaaaa

SEQ ID NO: 140 - DNA, 356 bp, dog
ctagcatcctatgcagtacaatctcattttggagactataattcttccattcatcatccgggctatctttctgatagtcagtttataccagaccagaacgatgactttttaacgaaggtggaatcgctccatgagcagcacagtgggctaaagcaatcagaagccgaatcttgcttcatcaacatagcacggaccctcgacttctatggagtggagctgcacggcggtagggatctgcacaatttagagctaatgattgggattgcttctgcgggcatcgccgtgtaccgaaaatatatttgcacaagtttctatccttgggtgaacattctaaaaatttctttcaaaaaaaaaaa

SEQ ID NO: 141 - DNA, 311 bp, dog
cctctatgatacaggtggggtttgggggagcttttcttctcacagaagatgcatgtatggaaactgacaattcaaggcatttcttctgcataaacagttgtgcctggtggatagttctttggaattcactggactacagtttagcatttcctaatgaaaagaggtaacagtatttaccacgcttttgttatattggattattcatagtagaaacttatcttctaaaagccaactgtattataactgaagtgttaacctgaaattggatggtttacaaaaaacagagggattttacatagcaaaaaaaaaaa

SEQ ID NO: 142 - DNA, 249 bp, dog
gattgccagtggcgttgttgcatgtttgaaatgcggtctgttgaagatggcaatcttgtatgcagtttggagtcagatttctccttgaacatcttttgataaacaaggtggtatgatcttaatgtatatgaaaaaaacttcattcttgtgagtcatttaaatgtgtacaatgtacacactggtacttagagtttctgttttgattcttttttaataaactgccctttgatttaattggaaaaaaaaaaa

SEQ ID NO: 143 - DNA, 148 bp, dog
cgactgtgggagctgccaaatatataaatcaattattaaccaaagtgaagaaatacttagataataatacacttatacttggtgacttcaatctagctctttctatactcgataggtcttctaagcaaaacatctccaaaaaaaaaaa

SEQ ID NO: 144 - DNA, 180 bp, dog
cgtacgtgagatggcttctaacaagttcaaaagaatgctgaaccgggaactgacacacctctcagtgatgagccgatcaggaaaccaggtttctgaatacatttcaaatactttcttagataagcagaatgatgtggagattccatctcccacccagaaagaccgagagaaaaaaaaaaa

SEQ ID NO: 145 - DNA, 371 bp, dog
tctctggtgcccatggaacactgcataactcgcttctttgaggagtgtgaccccaacaaggataagcacatcaccctggaggagtggggccactgctttggaattaaagaagaagacatagacgaaaatctcctgttttgaattaagatttgaaagaattcaaacattccagcatcctcctccatttctgaccactcctgaaaatatatgcagccacaatacttgtagatttatatttagcaaaatgtttgcatgtctgagaagacaatgagagtaattgcttgctaacagtgtatgcaccaagcatttaacattagctttgaaaataaaactttaaaattaaataaagtcaacatatgcaaaaaaaaaaa

SEQ ID NO: 146 - DNA, 349 bp, dog
gttatagttagagcaattttgggatacatgttgaacctagatttcaatgtggttataaagtaatttgagtctttgcctggagattgttgaaagaaaccaagaccaagtagaatactcagatattcagaaactatatacccatcttggatgctcagaaaagtatttcttaacattcttcatattttatctatatataatatatgaattataaatacaagattatatactggcttgagggagcctgttttgagaggtagacagtgaacataaccaggtggttcagtcagttatgcagatgagacagagggagcagttactgattcaaagataaaagtctgaaaaaaaaaaa

SEQ ID NO: 147 - DNA, 263 bp, dog
ttattcgccatttgtggtttccatgtcactcttcgtagaaacaggacagcccagtatcctcaatctttgccctcttccagctgcctcatcacagcactgcggcctccccctgctgcccaggcacgccatttccaagggcaggaaggggcagtgtcctgcagcccatcttttctgtgactgtcttaggtgatgcgtggccccctccacctttccacccaacaacttcctatccctgtcctgctgcacggtccagagtctgggac

SEQ ID NO: 148 - DNA, 365 bp, dog
agttgctaacatccacctacttactgagctgagaaaaattatctgagggcttaaataaaatggcatgatttaagcagggctgacaatagcactacagcgagaatctgattttgattatggattgctcggtttatggaatgccattttttttatatacctgtgcattttgcttcatttgaaaaagaaaatcagccagtgatttaaagtaatttttgatttggttcttcaagaggcatgtgctggtataggaaggtttaaaagccacacattgggaagtaagctaaggaaacaggtttggctttcattaccaactcaaaatcactcatctgtttattttttcaatgttccctttggtaaaaaaaaaa

SEQ ID NO: 149 - DNA, 188 bp, dog
gttggtatattggctaattgacatcttttcaccattatccttcttaaatatgcactctgattgcacaactaataaagtaaaatgttataatgtaggacattagatgtatctaagtatttaacttaattgtaaacttatcactatctattctgaatatttaattaaaatggaaagtctaaaaaaaaaaa

SEQ ID NO: 150 - DNA, 229 bp, dog
cggtcctggctgcaaagtgaaaaaccccaggtggcattttcaagtgtttatggactgaaataatggctgtacggtatctggcggatgctcaacttgaggaatcggcatttttatacagtgggagctgaggctataaacctcagcgtggcttcacataagccagaagaaactctcagcccgatacatatgtacaatttattaaaaacacatgaacacgtaaaaaaaaaaa

SEQ ID NO: 151 - DNA, 209 bp, dog
caagacctataaatgtctccatgtttaaagatgttaatatttggtgtacagtatctctatgacagtttgtgatatttatagtatgtacttaatttaatttctctttctaagtaaatcctcaaattcttttatcgcagccaattttgtaatttccataaacttagtgtttggaaaagagaggaaatttttactttctggaaaaaaaaaaa

SEQ ID NO: 152 - DNA, 377 bp, dog
accaggtactcatttttgatgtgcttatttttaattgcaccaccatcacccgtaacactttagaggtcctcttagaattgccttatgaaccagtcgataaatcccacaggaaaagcacaaagtatgagtttttatttattttttaatggttttatctcgttttataccccaggtttgattccaaatgatacttgattagaatcaaaaaatcaaactacaaagttcaaagatttgccactcttgcggatatttaaaagatttagtggcagaagcctaaggcaattctaaaatgtttcaagctatgggagcatttttacttttgttgtttgtttcaaataatcattctattcaagaataacatacaggaaaaaaaaaaa

SEQ ID NO: 153 - DNA, 236 bp, dog
ttgaggtactaggggttagaacttcaacatatgcattttagggcaactcaattcaacccataataacactatttctgggttgaagattcaacagtaaagatgccaattctcccctaaatgatttcagatttaatgaaatttgtatcaaaactcagcatgacttttagtaaagatgagtttattctaaaattatatgaaaagaaacccccaaaagaatagactttgaaaaaaaaaaa

SEQ ID NO: 154 - DNA, 299 bp, dog
tctctggacggggcacaatgtattcttcctgggtaaagagtcctgacagaacaggagttaacttctcagtaaactctaacttgagggacctgacaccctcccatcagttggaggttggaggaggcttccgaataagtgagtcaaagtgcctgatgcaggatgatactagaggcatatttatggaaacacctgtgttttgtacttcagaagatgggcttgtttctggtttcggacggactgttaatgacaatttgatcgacgggagttgcacaccccagaatccaccacaaaaaaaaaaa

SEQ ID NO: 155 - DNA, 62 bp, dog
gtctaaacataaaaaaaaaaagcttgtctaaaaaaaaaaaaaagcttgtctaaaaaaaaaaa

SEQ ID NO: 156 - DNA, 167 bp, dog
agtaggcagctgagaagagttgttggcctagaggacagggcaggggtgtgttcgagtggctggtttttgactgcttgtttgatctcttggtgtaacattttataaatcctttggcctgagaactaatatggcaattgccttaaataaattaatagaactctagtcca

SEQ ID NO: 157 - DNA, 144 bp, dog; identical to SEQ ID NO: 45

SEQ ID NO: 158 - DNA, 510 bp, dog
tttttttttttagaactataaaaatactactttggagaactccaacattacagaaatgtgacttcagaaatccaaagttactgcccataatcccactccacaaaattactataataactataaaatgtttattagttcagaatatttttcctatgaaaagactaatatatataaatgcctttaaaatacacaaattgcgtcatgccacatgtcccattcttcatctgtatgtttatctggctggtgtgcagtgatgtctgttacaaagatgttcactgaaaacctagttgggttttgtttttgtttttgttttttaagctagctttagggatgcctgggtggctcagtggttgagtgtctgcttttagctcaggacatgatcccagggtcctgggatcaagctccacctcaggctcctcaccaggagcctgcttctccctctgcctatgtctctgcttctgtgtgtctctcatgaataaataaataaaatcctttatttaaaaaaaaaaa

SEQ ID NO: 159 - DNA, 295 bp, dog
tgcaccgagataaactactgtatgaaagataagcaggtaatttggggtcattactttttatccattgcttcataagattgcaaatataggagttctaaaagtgaaagaagcaaataatcacttttctgtacatgaaagaagttctttttgggaataaaacaaaaagctagtgttcagaaaaatgaaaaattagacttttcaagaaaattgtcttatctttgccagtatgctaaaaattgtcagatatttttaacatcttctctgctaataaaatgttattcacgaaaaaaaaaaa

SEQ ID NO: 160 - DNA, 144 bp, dog
tatttatatgattagtaacgctgttttaagtgttatcccttttattgtattttatttataaaaaatgcctttatatattgagacctataaatataaatataaatatataaatatatatataaaattgcctgacaaaaaaaaaaa

SEQ ID NO: 161 - DNA, 444 bp, dog
cattccgtattcttactctctccctcaaaacaaatgaggtatggcacagcagcactcagaccaagcccattggatccttcaaattgagtgataccacctgctctaggccttgggccaagatgtccaaaattatttttgagcagtgatataaatcagattttatttgaggtcaaaactcaactatcatggtaggcagtgcttgaataagacaaagattctgatatatcttcaaaatgagtcctaatgaacatactaagtacttacaagttaagtgagcatacagtgtgtttcagaccaaaacaaatgaccctttcatatgttagtctctgggagaaaaggataacagtgcttcagaacatgtttttaataccaaattcttccagtgaactatttctcccaggattttaaaattgtcaagataaggtaattgttgaaaaaaaaaaa

SEQ ID NO: 162 - DNA, 253 bp, dog
ttgaggtacagcagggtaatattaatgaagccaggaatatcttgagaacatttgaagaatgtgttctaggattggcaatggttcgtttgagaagagtaagtttagaacgacggcacggaaatatggaagaagctgaacatttgcttcaggatgccattaagaatgccaaatcaaataatgaatcatcattttatgctatcaaactagcccgacatctttttaaaatacaaaaaaaccttcccaaaaaaaaaaa

SEQ ID NO: 163 - DNA, 448 bp, dog
ttgatcctcgcttgtagaagtggtggtgacttggaagaggctaagcaggtcatagacatgttgactgcttttatgttgccttctgactatttttgtcccattttagaatcactagttaactgtttgccttgtctatagttacttagtagtaatactcagctttgtaactacagtgggtaaagtggtggttatggaggttgttacaaggtttttttttctttttttaatacagtggttctgagagcttttatttttataactctcagaccttctgggacttccacatgcagtacagcattctgctgcttaaaaaaggaaagagaaagttagtctttcccttaaggaccccactataggagtgtttatatattctgtgtgtgtgatctcccactagccagttgtagcattaaattctggtaaagagtatatttacagggaaaaaaaaaaa

SEQ ID NO: 164 - DNA, 135 bp, dog
agcagcacagcaaaataattaagaaggtaagcaacacaaataaggacttgtaaaacatttatgtaatatcaaggggggttaacaaatcctttttgatactgactgacaaatagcagtagaaatgaaaaaaaaaaa

SEQ ID NO: 165 - DNA, 232 bp, dog
cactagccaatgctatatcctgctttattttacttataaaaatcattttcctactttttcataatattcttttcatggttctataatatttcaatgtgttattctttaagcacatatgcgactgcaatttttcaaatacatttatagttgaaacttaactaaatataaatgttttatatttatttaataaatggaaattttgctttaatttttcttgttctaaaaaaaaaaa

SEQ ID NO: 166 - DNA, 341 bp, dog
ttgatccatcagtttctttggaattacagactttcatctgatctgaaattacattcatactgcatcatagggataaacttttttgagggatgggggtcaccactgcccttgagaaaccaaggaaagcttacaaaaaaaaatacacctatacattcccactggaccatagacatggttgcctacagacatcaagttattaacaactcatcttctccataacaagccaagatcaagggatctgatgaagagattgtaacaaagtacatataagaagggagatgatgtaagaatcaattagatgctagaagagttcattagttgcttatctggaaaaaaaaaaa

SEQ ID NO: 167 - DNA, 276 bp, dog
aaatcgacagcagattggtgataaatagccagtctcatgaccctaaaaagtaccagaactagaaaaataattctagatcatctcaagaattctcaagtctgaattatcattcgaccttctggcattatagcaaaacaaagatattgaatattcccatgtcctagttccaacagctaaaaccatatcctagaatggtgtatgccacattttgagagcaactggaaataccaatgattatctatgatcaagacaaagtcctggggggaaaaaaaaaaa

SEQ ID NO: 168 - DNA, 207 bp, dog
cactagcacccaactttgcacacgtatcatacttgttgagaacaatgtttgggtctgcgtatcactaaagaatgcccaagaagtagagatgaattttaacttttaaacttgaaaattaggcactgtctgtgaaattgcacctttttttttaaaggtagagctgtatgtatggctattagttatgtcattggtttccaaaaaaaaaaa

SEQ ID NO: 169 - DNA, 166 bp, dog
ctagcatgatagatgttgattacctgtaagaatttttttgaattgcttcactggctccctgaggtttatattcagtcagatgtatatttttatatgtttgttaattatccgtggctttcataatctctatccattttcctaaccaaagaagtttgaaaaaaaaaaa

SEQ ID NO: 170 - DNA, 327 bp, dog
gagtgctgactaggccagtattgacatagaagtttcatgctcttggagagatactgccactctcttgctttgacaggtgttcatctgtagtatgagtccagtacttgaaggaacaagaggacaacaagcatccaggggacaacagtgtggtcttctaagtaaagatggcaacagaaaagatcatggacttggctagattgggctgggcttgtttgttgtttcagaattttaaaaatacttattttcttgatgataaaagtaacatgatcattgttgaaaaatcagaggtgtaaattaaaaaataaagaacacctagaaaaaaaaaaa

SEQ ID NO: 171 - DNA, 170 bp, dog
caagacctaaaatcactgtcaaaatgaatgtaatcattgctcagaatctaagaatatgatttattatttaagtggtggtaagttatggtattataagaggaggcctcagtgcagggcaaacatagcagttaaaatagacaatataaataatgttcatgcaaaaaaaaaaa

SEQ ID NO: 172 - DNA, 108 bp, dog
agcagcacacttagtacaatatgttggaaaatcacaaaatgttaaggatctgagtcataaacgcagagaacaaattggtggttaccggaaggcatggaaaaaaaaaaa

SEQ ID NO: 173 - DNA, 349 bp, dog
cgtacgttaagatcaataatccttcaaagatgtcttaccaatcagtctacatttttgctgcacttagaaggaagaaaccaccaactattatcttttctatttctccaattggcctacatgcaaaacttaagtataaagggccctcagattatcagtagaaccacagttcagagttctccaggtaaagagtccccctgcaggctatgaagccaaaccacataaaacacatcgctaattcaaactcctgcaataggaatattgtaaacacatatgaaagcaccatatggaatcatcctgcaatttcattagaaataaacttgggctagactccccccgccaaaaaaaaaaa

SEQ ID NO: 174 - DNA, 143 bp, dog
ctatttcatcttctccaaatatctactgcttattgaaaacagaccagttgccttttaatttttagataatatcttccatttggacatcccttcagacgaccagtagttttgatataataaatgttcatgttgaaaaaaaaaaa

SEQ ID NO: 175 - DNA, 281 bp, dog
ggtgaactagggaacagagaagtgatttaatttgttcacatcttcaacactcatttaataggcacctaccttgtgctagacatttgtctaggaactgaaatttcagcatttaggaaaaatcagtccaccttctaccctcatgaagcatatgatcacgagggtgggacaggtagtgatttaaatatatatataaaactgtagctgtataaatgctagaaaatacaagtatatgatgctaggattgaggaatttaatccaggcagggagatttaaaaaaaaaa

SEQ ID NO: 176 - DNA, 305 bp, dog
gattgcccagatctcaaatttctaatgtggaagtggaaactaagtgatggcaattgagtgatggtacatgataggacttctttttcgggagagtgagtgatttccacagccattacaaaatttagttctgatgaacacaacttctaaggattgtaaatagatatctccaaaggcaagtggtttgggatatactggtttgaacaaacttaaaaacacttcttttctgcaggacttctcagagcctttattatcctaatatgctttgtgaattggtgagagagggacatacatgttaaaaaaaaaaa

SEQ ID NO: 177 - DNA, 220 bp, dog
cgaaatgcatctatatgttcttgattcaaaaaagacacaataagggatccctgggtggcgcagcggtttggcgtctgcgtttggcccagggcacgatcctggagacccgggatcgaatcccacatcgggctcccggtgcatggagcctgcttctccctctgcctgtgtctctgcctctctctctctctgactatcataaataaatttagaaaaaaaaaaa

SEQ ID NO: 178 - DNA, 802 bp, dog
tgaattcaaactgggaaatttaaaggattcacagaggctagaggtttcttttaattttctgaattattatttagacttttccaagtgaatttaaaaataacactttagcattggtagtgctcagaatgtgtaaaattgtaggttatgaatctatatagacattcattttaaattaatcaggtatttcttaagtacataatagtgcagcaaacactgggttttcttctttttttttctaagaatttatttattcatgagagatacagggagagagaggcagagacgcaggcagagggagaagcaggctccatgcaggtagcccaatgtgggactcgattcagagactccaagatcatgctctgggccaaaaggaggcgctcaaccgctgaatcacccagacgtccctcatatgtgttttctagtagtggtttttacatgaaacatttggtaatttatcaattgaggaaagttgacattttctagggaaatacatataaagggaaacaaaatttacttcttccaaagaagaaaaaaattacaaaaataaggaaaagcaacaaagcatttgctaaccctgctcaagatgtgaaacaggatccaatccattttaaaacaatgtgtatagattgatttaattgtgaactctgttcaccctcactccaatatattacacaaaaattctacacagaaaaatatcccaacttacaattaaagagtatatattattaaattactaaaatatgtaactaaatcgttctatggaaatgagaaagaataagtattcaagatagaaaaaaaaaaa

SEQ ID NO: 179 - DNA, 163 bp, dog
ttaccgccagggatagactagttagagaagtccatgaacatgctaacctgcgtctcccaacacccacgtagtccgtgggagaccctccagccgagaaaacacgtctcgaaactgtgatcagaaaataatcaaacacacatgtaaatcctgtgaaaaaaaaaaa

SEQ ID NO: 180 - DNA, 502 bp, dog
ttgatcctactccttgtaatacactttctctcagagaaactgggggtagttaaaaaagtataaaacaagaggaaataatacatcatggaaaaacgaaaataggggacagcattgaatcattttagaaataagtacattctcaaaaggttgtaccttcttcaagcctactcactttgtaattttgcccataactcaaaactcttgaggaaaatgactccaagttcacttcttaagacacgatctttctgactacgataacttgttaggttttgattccgtttctaaaaggcagagtttggtctttagtattatagtcttgcccagcatctgcaatgtatgatactgatcaatgagcctcaggcacaattcttcagctttgagaccatgaaacaatcacataatgaccttacaccttgtcccctcattccaaaattattgccgctgatttgtgctgccatccactcatttctttaataaaggcattcaatcccaaaaaaaaaaa

SEQ ID NO: 181 - DNA, 223 bp, dog
ccagtgcacataaaacgctggtttggctttctcgaagcccagcaggccttccagtctgtaggtaccaagtggaacatttcagcgaccaaagctaaagtgacacctgagaaaaaacaagatgttgggaaatttgttaagcttccagtgctattattttaagataataataataataaaaagttattttctgacagttctttgtgctgattggtgaaaaaaaaaa

SEQ ID NO: 182 - DNA, 197 bp, dog
acgatgcattcaatttataagtatacttgcatgtgttcatttatatatacatctctattttgctgatactactcatataaatattatgtagttacataaatcatttctcatgcactacagcatattgtctattgtattattcaatgtcccttacataactttctgtataataaattcctaccagtggaaaaaaaaaa

SEQ ID NO: 183 - DNA, 275 bp, dog
tatttatggctattagttatgtcattggtttccaaaaaggaaaatgcattttgaatgtctgtgtccccatggttaggtgacagttccttgctgatgctgctttgcctgatgtaaatacagtaaatctcaatctttggctgggaagtgttgaatctcaaatctttgagcactcagtctagtaaagtcgttgtcatgtataataaagaactagttgaattaactatgtgaggttaactattaataaatgttaacatttttcaaaataaaaaaaaaaa

SEQ ID NO: 184 - DNA, 1000 bp, dog
caagtttcgacataagcatcagtccttctggcaaatcttcccggccccccagagccagctgggtctatcccaaatagatcctcacagttcctgtgttttactgaggttttcacaattgtgatttaactatcatttccacaattaatagtgtgacgtcagtgtttgccgtcgtactataatttctgtaagagcaggagtgatttctggttggttactgggaattggttcttagttctttggactgtgcctggggtatgatattactaagtatttgttgaatgaaggcaggactttcctgttttgccatattctgacgcatctggttgggagaaacgtcttcctgatgtaattagatatttttcactgaatgaatcaattccatcagatatttatattcgatcccaggcaactcccaaatgctttcacagcacccagtattttcctctattatggatgctactaaatttacttgtatcttgttttagaaaaaaaaaaagcttaagctttttttttttcagtttttgttatatcctcatttttttcatactctgcatccaatcagatgttctttcaaagaaatgtccctcagaggcactttattctcttggcccagtttggatttgttcttcagacttgctccgtgggtatcctcttgagatttcccttgactggtttcctttgttagaaccactgctctcccaggatcattcatcctctttctctttggtttactcctttgttttcccggagcacattctcaaataacttacttagaaagggtgttaacagtttaattttttttcctgagtcttcatatgttttaaaatgtattttctacctctctgattggtttatagttaggttgggtatggaattttaggttgaaattcacttttcctcagaattttgaagacgtttgcttcattgcctccaagaattcagtattgctattatgaatgttgatggccagtctcatgctcacaccccttccccaaacttg

SEQ ID NO: 185 - DNA, 188 bp, dog
gttataggatctaaaaatgcatatggaaggggaatgattaaaacattgtaaacctaaattatatgtcattatgcgtgtcttgagactggtaaacgtttaatgttaatgaaaattgagggtcgtgtggtccattaacacaaagcttctgagatctttaaaataaataattatttccccaaaaaaaaaaa

SEQ ID NO: 186 - DNA, 473 bp, dog
gggcctaactggcggaagcaagattcatggacagcaagtcagacttcctggagtgtttgttttttctgtggtattagcagaatttctatcaggctacccatgtggatgtgtgtggtgagtgggaggcttcagcaggacacgcagaggggaccatggccacacagtgaatgacaaccaagccctgagagaaatgtcagatatttattgagcagtcttattcagatgtgggtcttcgtaaaacgagtttaacaatcagatgacgatgctaaaggcaagtccctgagcttccaggtgccttgtgtatgagctgagaaccgagccgctgggtgtttgctgtaactgttcagaagccctggcggagagtcgctgtaacatgtcctgagcatttatgtggtctggttttaactgtaaatagtgaaagatttttttaagcacttttgcctagatttaaacagcaacttgaaaaaaaaaaa

SEQ ID NO: 187 - DNA, 240 bp, dog
aactgagcgagccaccccagggccccagcttttattgctgtcttaaataatgtattaatggacattctcatatacaaatatttgtgcatatcttttactattctcttaagaaatattcctagaagttgaatcaaaggacatttaaagtttaacacatattgacaccttgcatgtcgcaaaagatgtgctaatttataaaactaagtttcactagcttctcaacaaggtgctgttaaaaaa

SEQ ID NO: 188 - DNA, 147 bp, dog
aaatcgaccaggttagtaacttgttgggagaagaattcatactcactgagtgtgcggtaatggaataaagtaactcttaagtgttgaaacaagatcctaaggatgcatacttggatgtgtttcgtttgatggttctaaaaaaaaaaa

SEQ ID NO: 189 - DNA, 277 bp, dog
ctatttcaccaaggaccctgggaatagcagaaaagtgaagtcctcaagttccagtcctacttaaaaaggtgcatatgtgtccttcccagtgtctctgagattcaaatatcctccctttgaaggtgacccctccattttagtccattttatcccattgtctccaatctcctccaggtctctttctctcttgtactttgtctctacctttcctctggctctatttccacatcgatagacataaacaaatctctcctgccccatgtcttaaaaaaaaaaa

SEQ ID NO: 190 - DNA, 265 bp, dog
cttctagcaatattattgatttttggatttctaccttgtttctggtgaccttattaaaactcactatttacagaaccttcttatgaggatttcttgagattttccacataggcaatcatgttttttacagataggcatagtttcatttcttcttttccaatctgtatgccttttctttttttcatcttactgcaatggttaggactctgaaggagatgtgaaacacaaacggtgagagcagatatctttacatttttctcgattt

SEQ ID NO: 191 - DNA, 175 bp, dog
tcgaatcattagagaaggtgttttaattgctctaagttgataacaaactcttttgtaataatatgtaccgtaggacatgagtctcttttccctgaaattttagatgtagacaagtgctaggcattagaaatttccattttgttaaataaatgcttagatcccataaaaaaaaaaa

SEQ ID NO: 192 - DNA, 249 bp, dog
caagaccgaattctgtgtgcaaccgagtacagtgtccggtgaaaggacctccaccgggtttgaaagcaactaatttattttccatttcagcagagtttacattatttcccattgcttacacttgagaatgtttattttacgaggactaagggattaagagagcgcgaacgaaaaggtagcatcttctactctggagttttctatgttgtctttgaactgcaaataaacatgtatctagaaaaaaaaaaa

SEQ ID NO: 193 - DNA, 203 bp, dog
gcaagttgttacagcagaagaaaaaagtactggtttcattggctgcaaggttccagatagtaaccccaaggccgaggtgcgctataaaatccggggaaagtggctcaaacagtccacaggtgagactttttacaggaagccaaatgtcattaacctagtatggagctctgtgtgctagggaccgtgaataccaaaaaaaaaaa

SEQ ID NO: 194 - DNA, 328 bp, dog
tttttttttttaatgcaatgtatatttattgtaaacaataatatacaaaaaaaagagaaagaaaaaaggaaagatgagttcacagagagaacaaaaggtttggggggcggggaaacaagcaaaacaaacaaaacacaaacacaaaccaaaccttacctaaggacaaaatatgatttaaatgccaggtttcttaagttacagaaatatttttttaaagatctgcttttatacagaaattgaaagatgccatattataagagtgctttaagattttattctactgacttctaaaactgttaatatatctttttttaaataaaaaaaaaaa

SEQ ID NO: 195 - DNA, 295 bp, dog
cctgcaagcaaaagatcaagaggatttggttttgtgaccttttcatccatggctgaggttgatgctgctatggctgcaagacctcattcaattgatgggagagtggttgagccaaaacgtgctgttgcaagagaggaatctggaaaaccaggggctcatgtaactgtgaagaagctctttgttggtggaattaaagaagatactgaggaacaccatcttagagattatttcgaggaatatggaaagattgataccattgagataattactgataggcagtctggaaaaaaaaaaa

SEQ ID NO: 196 - DNA, 162 bp, dog
ctatttctgtaatggtgatttagaatgtcagattacagggccccgtctcaaagaaaattggccttgactttctgtaatctagaagcactttgagatgtttatacagcgttcaagagcctttctaccaaacaataaactagaaagaactgtgaaaaaaaaaaa

SEQ ID NO: 197 - DNA, 277 bp, dog
agaggcaacgaaaaataaacccaaaatggtttcttccaaggacagcgcaaaggccaatcccagctgctccatcactccaatcacaggcaacagctctgacaaatcagaagataaaggaaagttaaaagccaacagttgcattcagccatcaagctctgaagggggctcgtttctcctcaaatctggcacaacacccttgccacctggagcagccacttctccctcgaagagcacaaatggagctcctggtactgtttctgaatcagaaaaaaaaaaa

SEQ ID NO: 198 - DNA, 316 bp, dog
tatttatgtcaagaggcatgtctcaaaatcatctcatttcaaatgatagtgaaatgtgtgagcatttgttcatgtgaaccactcctcaggtgtctaacaaagttattgtgtatacaaagttgaggatcattactcagagaagggcaagtggggacatcccagaagctttgtctccagaggaggagctgcaccctgcctcatttccttccaacacacacatctgtgaccctctgctgtccttgtcctttgcctatattgtacaatttcatgctcagatgtgatgcatggatgaaaattggaattgtaaaaaaaaaaa

SEQ ID NO: 199 - DNA, 328 bp, dog
cgggtaactaatgaagaagtggtcaaccacagaatcttcaataaataagaaattctgtaccatctgaaagtagttcttgttggtgccttcattttaaaaaaagcactttaagattaaagggaaatgttttctgataaaatacaaacttcatttagtacaggttcttaatataaaacaattacaaattgagtattgtttgtaaaatagtaatatcaaataagctagaggagaaatgtatcatgttttaaaacatgagtagacagattaaaattctattttaattataaagtttataaagtaaacacttttgtatttagaaaaaaaaaaa

SEQ ID NO: 200 - DNA, 312 bp, dog
tcctggaaccctaaaatgggataggagatcagagtctttcaagacagatggtaccaatgatgaccatcattggtttaagtttaatttagtcagaaatatgggtactggtctatcacagtggggtaaaatgatgacctcttcccagccagagagatcaacacatagaaactaatcaggaagctctaggattggcttgagcctttctgtggtcttacaaccttgttctcacatcacttttaacttacccagcaccagtttttgccaaaggagctaccaaccaatcattttgcatacttcgtcgaaaaaaaaaaa

SEQ ID NO: 201 - DNA, 299 bp, dog
tttttttttttaaaggtagagctgtatgtatggctattagttatgtcattggtttccaaaaaggaaaatgcattttgaatgtctgtgtccccatggttaggtgacagttccttgctgatgttgctttgcctgatgtaaatacagtaaatctcaatctttgactgggaagtgttgaatctcaaatctttgagcactcagtctagtaaagttgttgtcatgtataataaagaactagttgaattaactatgtgaggttaactattaataaattttaacatttttcaaaataaaaaaaaaaa

SEQ ID NO: 202 - DNA, 249 bp, dog
cctgcaaccagagtatttttgtacagatgtgctctctcttacaaaaaaaaaaaaacaaaaaaaaaacaataaaaaaaaaaagcttgtgtgtgttgtattaacataaaaaaaaacacgaatttgtgttatgtgatcagttttgggggttagctttgcttaattcctcaggctttctgattcaaggaggagctgccttagaaagaaaaaataaaggccttattttgcaaataatggaagtaaaaaaaaaaa

SEQ ID NO: 203 - DNA, 257 bp, dog
cctgcaatattccacactactggggggttggggtaccagctgctgtgtggggtctggaaacccgcgactcatggctgttcagagtgtgttcatgtgtgtgtgtgcgtgtgtacatacatgtatgtaaccgaggtgtcgtgtagaatgtcctttggtagctctgggttggttgacagatggttttgtgatacttaacccccttgccttggtattgccagtttctcgtgcaataaacaatcagcagctaaaaaaaaaaa

SEQ ID NO: 204 - DNA, 327 bp, dog
ttttttttttttatttaaaaaaagatatattaacagttttagaagtcagtagaataaaatcttaaagcactcttataatatggcatctttcaatttctgtataaaagcagatctttaaaaaaatatttctgtaacttaagaaacctggcatttaaatcatattttgtccttaggtaaggtttggtttgtgtttgtgttttgtttgttttgcttgtttccccgccccccaaaccttttgttctctctgtgaactcatctttccttttttctttcttttttttgtatattattgtttacaataaatatacattgcattaaaaaaaaaaa

SEQ ID NO: 205 - DNA, 514 bp, dog
tcaaagataattttaagcttctgacctgatcatttaaactctttaagtaggagagctaaattagaagctcagactttagcttgcgaagttaatgaatttttgaaagggaactttttatgcaacatttggaataaaagactgctggccaatcagtgtcatctccaaggtgaattttggtgtcacattataaggaaatgaataatggatggtgtctagattatctagtccgaacagtagagttgattttttcttcatctgaaccaacatgctacagtagctaagaagtattaaactatatacatccatataaagatgaaatatgatctatcccattagaactcatagttgaacactgacatgttattcttgtgaaagagccacgttttggttttttttccttgtcacatgatttatttccttgatggatgaaaagtatgaaaggaaacttttatatctgttgcctagttttgtatatggatctcattttacaagagaatctctgcaaaaaaaaaaa

SEQ ID NO: 206 - DNA, 195 bp, dog
ctatttccagggagaagaaaagtatctacacttttttgtttttccaaaagagaaaaaaaaaaataacaaaaggtgaaacttctatacaaatattacctcatttgttgtgtgactgagtaaagaatttttggatcaagcagaaagagtttaagtgtcttacaaacttaaagctactgtagtactttaaaaaaaaaa

SEQ ID NO: 207 - DNA, 332 bp, dog
gccaggccgaggcccactacaaaggaagtaaacatgccaagaaggtcaaagcactagaggcaacgaaaaataaacccaaaatggtttcttccaaggacagcgcaaaggctaatcccagctgctccatcactccaatcacaggcaacagctctgacaaatcagaagataaaggaaagttaaaagccaacagttgcattcagccatcaagctctgaagggggctcgtttctcctcaaatctggcacaacacccttgccacctggagcagccacttctccctcgaagagcacaaatggagctcctggtactgtttctgaatcagaaaaaaaaaaa

SEQ ID NO: 208 - DNA, 166 bp, dog
catatgcaagaggaactatgaatatatttcctttctccaattaaatgtggttaggtggcttctatccatattaaacccaaggatatgaataaatctgcctaaatattttctttgggatcaggatcattttctaagtaaatcccattggatgatgtaaaaaaaaaaa

SEQ ID NO: 209 - DNA, 380 bp, dog
tcctggagtgatgaaagaacatccccgaatatgtgcgtatgccagagcctgtaggtcaggcttatgctgtagaaagccctccccatcctgggcagaattcagaggctgcattctttgtgaaaatcacgaggtgaaatcacagttttgaagaaagtcagaaaacaagcctgagagtgatttgttaaacccagcttgtattaataagaatgaacctttctcaagcacctgccatgtgccaggcactgagctagacactttatatataggttggtgctttgcgacatttaagaccagaggaaagtaggggagaattaaggataacccctggggactggggaacgtggctcaaaataaaccaacccaagtgtgaaaaaaaaaaa

SEQ ID NO: 210 - DNA, 535 bp, dog
agaggcataaaagggaaaggtcccaagggcacgtgtctggagaaccaactcctgactctgtgatagtagaaggaaatcgagtctcaagtgactttcctcagcatgctgggaaacagggctactgggtaataaatgtagctcctcacaattagtgccactctctgggtctgggcccctgtgtgtccagatgacccccaatactccagtcctcttggtgaccaggtgggatcaaagcctgggaggaagtggtgggtgactgctggtgagaggtgcccctccctgggcagagaaaatgtgcagcggcggagagcagggcgctgtggaatgtgtgggtcaactgagtccccaggggccatctgcaacgggcctcgtgggctctggcaacctcttgtcaattagccaggtccaggccaaacataatatcttgacaaagagcgcttcagttcagttcaaatagacttcctctacagagcccataatacctaatgaggttatttaatctagaaagaaatccaatgacctggaaaaaaaaaaa

SEQ ID NO: 211 - DNA, 302 bp, dog
tctctggggagatatttgataagccacctcaaaggatcccttcacctaattttgagaatggctgactaagttgatttaagatggcttttcaaaaagttacacaatagtttgtaaagatctttaagcagaaacttgttggaaattatctctcctgtctctgaattttgtggattaagtatcactttcattattagagcccattttatttgtttttgtctctcaactcaataattataaaatgattaaaaatatttttccagaaaaagaagtactgcttatttagtatgtctcaaaaaaaaaaa

SEQ ID NO: 212 - DNA, 294 bp, dog
cgactgtcccgccaggattccaaggcagtttctgctgatgcgtctggccggttttcgtgaaaggccttacagaggagggtctggatgcgtaggtcatgctttcgatggagacgacgtgtctatgaatagtccattgcctcacaaaccaaaatgaagatatcacagcattgaagctctgctgaatcttgaattttatgccttcccaataaccttccccgagatacagaagatgccccagaatcatacgtctatcgttttgaaaatattaaagcagtttgctctcaaaaaaaaaaa

SEQ ID NO: 213 - DNA, 194 bp, dog
accaggtgtatctcccaactccttctaagaaggaggaaaactttcttctaagtgaagataacatttaagaatacatgtttttacatgcttgtaatattttggttgtgtgtgctttttgtcttttaagttattaaagaatgtctgaagaataaacttttctttgtggagtatctacagcctttgaaaaaaaaaaa

SEQ ID NO: 214 - DNA, 158 bp, dog
accaggtgtatctcccaactccttctaagaaggaggaaaactttcttctaagtgaagataacatttaagaatacatgtttttacatgcttgtaatattttggttgtgtgtgctttttgtcttttaagttattaaagaatgtctgaagaaaaaaaaaaa

SEQ ID NO: 215 - DNA, 158 bp, dog
tgaattcaaggaagaaatgaataaatatgaaatataagcacatattcattatatacctatagtttacaaatcttcctacaagcagcttacagattagtaaacatcacatgctcaatgtataattatttaatcaatctttggaacattaaaaaaaaaaa

SEQ ID NO: 216 - DNA, 180 bp, dog
accaggtgtatctcccaactccttctaagaaggaggaaaactttcttctaagtgaagataacatttaagaatacatgtttttacatgcttgtaatattttggttgtgtgtgctttttgtcttttaagttattaaagaatgtctgaagaataaacttttctttgtggagtaaaaaaaaaaa

SEQ ID NO: 217 - DNA, 347 bp, dog
aaatcgagtgaccgatccgatagagatcactgtgttccagtgcttagacagaaacgaagttttggaagtgcagaaaatacaactggaaaaaggaaatgttgattcatgttggttctgaaaaggtctgaagaaagcctttactccgtgcagatctactgctcagctctaagctatggcttttggctcaccaggtgtatctcccaactccttctaagaaggaggaaaactttcttctaagtgaagataacatttaagaatacatgtttttacatgcttgtaatattttggttgtgtgtgctttttgtcttttaagttattaaagaatgtctgaagaataaaaaaaaaaa

SEQ ID NO: 218 - DNA, 165 bp, dog
cactagctaaaagataaataacttggagaaaagtcttgagagattgggaagaagggagagaacggcagggtggcagcaatggtaaaaatccctaatgttttaatttacagcccaaacttctgatatataagtttgtatgtattgactcagatgcaaaaaaaaaaa

SEQ ID NO: 219 - DNA, 262 bp, dog
ttaccgcgtcatcatcttagtccgactaaggcagttaatgtaatgcgtagatggaggaaagtcccgcgggagccaggacggtcctgggcacgtttatgctttcctcctagtcagcacccagaggaggtcgacgccagagaccaccgctgggtggatgctggcttccagaagggccagagtccctcttttaggaaactcttcagaactgggagcacagtgactgagtttgagctattaaaacccttcttcataaaaaaaaaaa

SEQ ID NO: 220 - DNA, 623 bp, dog
gattgcctatttattatttatgtatttatttaagaaacaaatatgggaatatctgtgcataaatttggaaaaataggaaaggaagcattgttgataagttaatataatgatggtagtgaatttatatttattttggtatttagtgatgttatattaaagaactattttgaacaaggttgctagatttagcaaaattaaaaatgagatactcatttaatttttatttcaaacaataattttttattatattattatttatctgaaatttcaattgaaccacaatcctacttttgatactcctagtcttgtctattcactgacagccttgttcaatgctgggttgaatgatcagaaccctgagttagaattgtttctccaaagagcaaaaactcgacaagcaatattaatgaagtaatttcttgccagttaaaatttgtatatttataatatacaaatagattcttataattttacttattgtgttcttaaacactgacttttttgactttaagatgcttttatatgttccccaagagattttttttcctactatttttgatgctatggaaatagaaatgtaaaatatttaaaataaaacttattgtcaaagtcaaaaaaaaaaa

SEQ ID NO: 221 - DNA, 493 bp, dog
cctctatcataacatttcacattttgctggaattttccaacacatttctgtatctcagccagtagactatcagttctatgatgaaggccttctctggtcctctactatatatagttaggatatagatgatatagatgttactttgacccatagtggatgcacaatcatttatacaacttcagcccagtgaacctgagatactgtagtgagttttgttccctaggaagaagttctgtgctctttcatagcttctcttatgcttacccataggggaaggccataactgggagatctgagttcaaattctgttggttagtcagttcctaactgaggccaatgtcctgaaggcagtcctctgggaatcttttgcagacaggaatggagccatgcaggaatagatctcagccttatttctttcctctgaaccaaactggctctgagtaatgcctttgcgatcctgaccacatcctctttttctactgccaaaaaaaaa

SEQ ID NO: 222 - DNA, 266 bp, dog
cctctataggatcgtttatctcgcttacagcggtgatgcttataatttttatgatttgggaagcctttgcatccaaacgagaagttgctatagtagaacttactacaactaacattgagtgactacatggacgtccccctccataccacacgttcgaagaacctacatatgtgatccaaaaataagaaaggaaggaatcgaaccccctaaaattggtttcaagccaatgtcataaccattatgtctttctcaatcaaaaaaaaaaa

SEQ ID NO: 223 - DNA, 437 bp, dog
aataacggtatgctgagagcctatttttatttccatatacatgtcttactgtttttatttctgcctgatacaccactatgtgtgtttatctaaccggtgtcatttattgatgaatgtgtggacttttccaattttttgatgttgtaaagaaatctgtaatgacattctgagtatatccatgcatatccattctttaagtcatgatttggcatactttttctataaaaagccagacagtaaatattttagactttgcaagtcagatagttacagtcacagctactcaactctgctgttctaacctgaaagcagctacagacaataattaaataatatggctgttttttagtaaaacttctttaaaaacagtccccaggttacagtttgctggcccttgatctaagtgattctttggtcagactaccgaaaaaaaaaaa

SEQ ID NO: 224 - DNA, 176 bp, dog
cctctatcacttgcctaatgtcctatcttcttaggggctgaagattaagcccctaagtatactgactgacaaagattggtgcttagtaaatatttgtgatagcctccttgctggtcctcatgtcctaatgacgttttgctatgtaagcagtcagaatactcttccaaaaaaaaaaa

SEQ ID NO: 225 - DNA, 244 bp, dog
gagtgctctgtggggacatagtagtgaacctggacttctgggctctgctgggaagggatgctgagctgaacttgctgttagagcagggctctgcccgagttgaggtggcgaagatgtatctggtcaacttggaattctttgggctgaattagtttaagatcaagattttgtaatttaatcttacctacagagtagaattacctggagagctttaaaaacaacccctcccctccaaaaaaaaaaa

SEQ ID NO: 226 - DNA, 555 bp, dog
ttgaggtaatctatatgcctcttaaccaaataagagaaagaacgaaaaatcttgaaagaggggaagaaatccttgtgtgccttcatctcataattggacactccttctttggccactttctttgaaaagattcctttttaaaaagactgctggaggcagagggaaaaaatgtgatttaacctagggcttagaataagtcctgtgaatctctaaaactttgttggagatgtcatacactggaaagaactatacttaaaagcttcaggcttttctctgattcgccttttatatgatttgtgaacataaagtcattatgcagatgttctctgcactgaaagaccactttgataaaccttgaagtttttcaaagataaagcaaatttgaaaatagagagattcaagaaaatgtggatccaaaagctgaacagttctccataatattgtagaaagctatttttattttagttggcatttcatcctattgtattatgtttcccttaggaaaaatatattttccaagttaacatttagattgattaatctccaaaaaaaaaa

SEQ ID NO: 227 - DNA, 238 bp, dog
cctctataccaccactaagaaagtacactctggtccttttgtctatttagtttttatatcagttttatttcctgttggaactgcttcttacatacatttgtccatgatcaaaccttttatttcttatttttccagtggataagaaaatactaagatttagaataacttttcagcccttccaagttaactatattcaatttcaccttctttgtttaagaatgttacccaaaaaaaaaaa

SEQ ID NO: 228 - DNA, 220 bp, dog
ctttggtattataaacagtcagtggaaaaagatgcatattatttttcacattactaccctcaaagaaattatttatttccagagataagaaatatatctgtgtaaattcaaaaaagaaataaattgaataaaaaaaaataaattgaataaaaatgatttgcccaagatcaaagctagttagcacaacagctagaattataccaaggtctaaaaaaaaaaa

SEQ ID NO: 229 - DNA, 426 bp, dog
agttgctgtcaagtgcctggagtggtgctttattttttgtttgcctcacaattacattggtggcatgtgctaatataaagagctttaacttcaaacattattggactaaagagatgaacggttgtgtgacgacagaaaaccagatttttgccattttaagagcaacagtattcctcaatcctgtctgttctgcagtactaagctaagaacaggtaaaacagggtaacggtaatctggaccttaatttctgcagttcatttcttttaatgttcttgtctgcaaaaactcaggaaagcgattgtgatttgtacagtacctcaaaggaatgtgttgaaagcactatgtactgctgatagtaatgggataggcttcaatgttactttatattaaaatgtatgtttacctcaacaattggaaaaaaaaaaa

SEQ ID NO: 230 - DNA, 320 bp, dog
cactagcacactttctaccccaaggcacccctcttcccctaattccaatactagtagtcatcgaaactattagtctatttattcaacccatagctctagccgttcgattaaccgccaatattactgcaggacacctcctaatccatttgattggaggggctaccttagctcttatcaatattagcgcgaccacagcttttatcacttttattattctaatcctacttacgatcctggaatttgctgttgccttaattcaagcctatgtttttaccttactagtgagtctatacttacatgacaacacctaaaaaaaaaaa

SEQ ID NO: 231 - DNA, 53 bp, dog
ccacgtacaaacacagagaggatgaataaactattttgctacaaaaaaaaaaa

SEQ ID NO: 232 - DNA, 219 bp, dog
ggagcttgaagtgctgctgatgtgcaacaaatcttactgtgcagagattgctcacaatgtatcctccaagaaccgcaaagccatcgtggaaagagcagcccagctggccatcagagtcaccaatcccaatgccaggctgcgtagcgaagaaaatgaataaacagcttatgtgcgcgtcatatttgtgttaataaaaccataaaacttcaaaaaaaaaaa

SEQ ID NO: 233 - DNA, 252 bp, dog
acgttagggaagaaaggaaagaaaactgttggtgtgaaaaagccgaagaaacctgtggtagggaaaaaggctgcagctaccaagaaaccagcagctgacaagaaacctgcagaaaagaaacctaccacggaagagaagaagcccgctgcctaaaaacttatatttgtttattccataaaactcaaatcattttggacagctaattttaaataaagacctgatcaaagacagtgagaaacataaaaaaaaaaa

SEQ ID NO: 234 - DNA, 525 bp, dog
agaggcagataagaacgacaaggctgtcaaggacctggtggtgctactgtttgaaacagctctactctcctccggcttctcactggaggatccccagactcactccaaccgcatttaccgcatgataaagctaggcctgggcatcgatgaagatgaagtggcagcggaggaacccagtgctgctgttcctgatgagatccctccacttgagggtgatgaggatgcctctcgcatggaagaagtcgattaatttctccttgcagatcttgtgccctctgtatagtgtccccatggctccccagcagccctgagtggccccggttcacctggttccctctgctgatgtctagtggatttttttttttctcctcctgtctttgttagaggcaggacagaagggccttaagccctagccctcatgacatttgacaaggggtttggatgtgtattgtggtgtttgtttattttgttctgagattaaagtatgcaaaataaagaagatacggttttatacaaaaaaaaaaa

SEQ ID NO: 235 - DNA, 352 bp, dog
ttattcggccagttgtcgtattgaatttaaattctttaactatattggatataggtcttttgtcaggtattttgcaagtctttcagtttattgccttttcacttattggtattctttgacaggcagaagtttggtcttatcccttttccttttatgttttgtgttttacacgaaatcttttgccatttcatccatcttgaagtgatgccttactctagtaattgtgtagttttggtctttgcattgaggcatatgatccttttcaaattattttttattatccatgaggcgaggatcaaggttcagtttcttctgtgccatttcttctagtgctgtttctcaaaaaaaaaaa

SEQ ID NO: 236 - DNA, 502 bp, dog
aaattttccatcaaacttgtaagtaaaattaaattcatgtacttttttcatctatttccaaataatcatttactaccattaataacaaccattaaagagccatttcccacatctgaagcactgccctacatactctacttacctgcaataatcctcactgtaactatgaaaattatttccatggttacataactagtaagtgacagaacgaggaaggattctgattcgtcactattctatcctacgttatttacacctttgacaattatcctttccaactttgattacttctggtccctatgattagccattagtctacacactggatgaaagtaatacaaggtctatatagaaccctaaagctcagtgttactgttctacaaatgtgattgtggaaaaatttacaaaatatccatgacaaccatgtagatcatatcccatctcactatttactattctcatcccttctgataaacctgactttgaaatttaaaaaaaaaaa

SEQ ID NO: 237 - DNA, 301 bp, dog
cgggtaaatacccaatagtgcaattgctggatcataggatagtttttgaggaacctccatactgttttccagagtggccgcaccagtttggattccccaaaaacagtgcaacagggttttccctttctccacatcctcaccaacccctgttgcttctcgtgttgttgattttagccatcctgactggtgtgaggtgatatctcattgtagttttgatttgtatttccctgataataagtgatcatgaacatcttttcatttgtctattggccacctgtatgtgttctttgaaaaaaaaaaa

SEQ ID NO: 238 - DNA, 248 bp, dog
tagtccatataaatcgggcaatcaagatttctctcagtttaatttgctttctgttgaggatttaaatgatattatcctgaagctttagccaaccacttccactccctaatccttggccttcctcactggtgaaaggctgttctcagttttcttggttcagtttaaccctcctagttaatctctgacttctggtaaattgccatcatgtttaaaatctgcaattgtaactcttttcctaaaaaaaaaaa

SEQ ID NO: 239 - DNA, 206 bp, dog
caagtttggaggaggatattaaagaatatttgggaggtgagagttgggaatgcatagcagttaccagactccgagagcaaaggttttattgccattgtgaaattgagtaattactagtattttgtcacttaaatctctgttcactgtctcttttccttctgtgagtgatggattttatcttccactgtcttctgcaaaaaaaaaaa

SEQ ID NO: 240 - DNA, 142 bp, dog
tgaattctgaagaaaatggattaaggaaatatatttttttcttctaaaatgtattaaattcttatgacagataatcattttgtctttgcaggataaagttctcagtgaccaattttatggtgtttctttttaaaaaaaaaaa

SEQ ID NO: 241 - DNA, 402 bp, dog
cgtacgtgtaggcttaaataattttttctggcactcagctcaatttccagatttatttatttatcaatattttatgaatgaccatactgtgcatagttatttattggataaaataagcttctagtacaaaacacaaaacagtttctactttcaatggaatcaattaaaatcagaatgttaattaaatatagtaaaacttcaattatccctggttatggaggtaataggtcaactctaatccaaaccaccagacaacatcacagaatatgtacattttgactttgtaatcaattttagcatatttagcattaaattacacccacagttgagagaggccagtcttaaaggcaggattcaaatttattgtgcaagagtataacatcgaagccatgaaaaaaaaaa

SEQ ID NO: 242 - DNA, 275 bp, dog
cgacgctggaaggggaatgaattacaacgttgtatccgaaagaagaaaatggttggaaatagaatgttccttgatgatctgcacaaacttaacaaacgcatcagctacctctataaacactttaatcgacatggaaagtaccggtataagagaaagctggaaactagaagaggcacatctgtcacgccggagaaggggaacagtacttttccttataagggaaggaatttgtatgctccctgtaataaaatggggcttctttggaaaaaaaaaaa

SEQ ID NO: 243 - DNA, 252 bp, dog
cgtacgtaccacaggctgctttgtgatgtccaccaagtccttaagattataatactgatgtttctcaaatgccgaaaatagcatgtctaaaacgtgttgtttatcagctcgagctcgttttccatcttctttctttttcctttcatattcaatctaggtgcaaacagcaaaaagtaataaaggcatgaattcaacatggtcattttgaaagacaggcattctctttttagccgccccctccaaaaaaaaaaa

SEQ ID NO: 244 - DNA, 598 bp, dog
tttttttttttatgctaataaatttgaaaactacagacttagaatagtgtggggacatatttttgagctcttcaagaacctactttttctatgcatctttgtttctatttgtaggcaggcttcctttattggtttccaatatttctccagagaaaatttttgcttagtattttgaaccaagaggccagtttagcaatttaagggattatacaaaaaataattccacagacttttgaaaagaagcgaagtttaacctaagtgacaaaatctaacaagagagatgtattagatatcttcaaatctcacttgtctttagagacaggacattaatgaacaagttattaaaaatgaacggaacttggaagcttcctagttccccacaacatagtaacttttcttctttaaaatatggttttagggatccctgggtggcgcagcggtttggcgcctgcctttggcccagggcgcaatcctggaggcccgggatcgaatcccacatcgggctcccggtgcatgtctccctctgcctgtgtctctgcctctctctctctctgtgactgtcataaataaataaataaaaaaaaattaaaaaaaaaaa

SEQ ID NO: 245 - DNA, 141 bp, dog
agcagcagatggcattatcaaaaacatgtctcctgaaaaacaagtcaagtatatagaaatgaaaaccacaaatgagaaattgttgcaggagttagacacacttcaacaacaattagattcactgaacatgaaaaaaaaaaa

SEQ ID NO: 246 - DNA, 222 bp, dog
ctcaacgaggacggcagccccaacctggacttccggcctgaagaccagccccattttgacacaaaagatgagttttgatgttctatctgcagaagcctgttcctgatatgtgggggtgcgggcagggagacctcatgtgccaaatctgcaaaacaggccacctgagcctctgggctccccggacctgaataaagccgatgttgaacccgggaaaaaaaaaaa

SEQ ID NO: 247 - DNA, 394 bp, dog
gattgccaccaacatcctcctggttgacgagatcatgcgagctggaatgtcttctctgaaaggttgaatttgaagcttcctttgtgtcatctgaatcatgaagactacagagagaccttaaggatatagctatggaatttttgtccaagcttcaaataattttaaaaagcattttctttccccatattaaaagagaatattgatacttaaattctgaagttctgaaattaaaattacagtattttttttaattgcactgcagtgtacacacattaagtaggctatttatacccagtgaaccagatgttttgctttagcttcagtgatgtaaaagtaccatgttaaataagtatgttatctaccttgttattaaatgttccttgaaaaaaaaaaa

SEQ ID NO: 248 - DNA, 312 bp, dog
gttgtgcaccatagacagtgtctcctgctcttatttttttttccctgctcttaacctcaatatgtgtaagagaacttcagtttaatttctccacaaatgtgccaaaaggatttgcctgcataaatatctctggtggtgtctatgtaaatatttcaaggaactaatgtaaacacaatagtcactttattatgataaaggtacattttttgcacttatcagattttgtagtctcccattaagttggcatggggcaatgctagattcaatgattcttttctaaatcttggctttcttcactgattaaaaaaaaaa

SEQ ID NO: 249 - DNA, 149 bp, dog
agttatcttaataggaccaaaacagctgccaaaatcattagaggttagtcacccacgtgtgtcttttttgagggaaacaatctgtaattagctctgtattcaccagctggtatcactcctgctccctctccccccaccaaaaaaaaaaa

SEQ ID NO: 250 - DNA, 345 bp, dog
tcatatgtgcagggaactcttactctttctgtatacaattgatcggttttcacacttgaatagtcttcataatggtacttatgttcctgttcttaattctatactacatgtattatttaaaatactgaagattcaggaaatttgctttgtcttgtggtgtgatctgtaacagaggtctactgtgatcgtatgttatcctgaagaatatattttcttcttaatttttaaggttacctccaggagtcgctttgaacctaccaggcatagcttaggaagatgttacctgctctgctgatttatactaaaagggaagtttttagggaaggtagttgtcaaaaaaaaaaa

SEQ ID NO: 251 - DNA, 266 bp, dog
cgtacgttatgaaagtacttcttttgcccaagtgcccacccttttttcttatcagcattaggtaggaatcgtatttgcttcaagaaaatggtttcaaggaactaatgatggatgttaccgttcttaaggaggatactgttcccttggcgtcaggttttgtttagtttagtttcaggtgcaagacctgcccattattattattattattaagacctgcccattaaaatgaaaatatcattactaggggattgagtgaaaaaaaaaaa

SEQ ID NO: 252 - DNA, 311 bp, dog
gccatggtttatggatacaatgctgcctacaatcgctatttccggcatcgccgaggaggcaaatgagattgaaaaaagtctctttccttccagagcctggtgcctggttttgtattcctttacagtagcatcatcgaactacataaacacatacaaattgcttatttcttaaatgttcttgtctggctgttgccctccttcctgccccccagatcaataagcagtgaaagtgcaatgtggtgaaaggtcaaaagagaattaagatgtgtgattattattacataataaactcttggatggaaaaaaaaaaa

SEQ ID NO: 253 - DNA, 145 bp, dog
aacgaggatgaagattcaccaaacaagctctacacgctggttacctacgtacctgtcaccactttcaaaaatctacagactgttaatgtggatgagaactaatcgctgattgtcaaataaaggtataaaactgcaaaaaaaaaaa

SEQ ID NO: 254 - DNA, 486 bp, dog
ggctgactataccaacgagaagaaagaaactccacataaattatattttgtaacttatttatattaagaaatgcttcttacctatttttgttttcatttttttggatggctacataagactttcttccatttaaggtttaaatcatgtgttgtttaaaagctgcaggtaattttcaaggtgtgatgaaattttaatggaagccttgtaccagttaagtgaaactggcaaaggagatcttactttgcctatagtgcattcaagattatacaattaggtttaaaaatgtctgatttgtaaaatacttagtgttatatcagacttataaaataaaattttctgtgtgagaactctgttaaagaaaatgcatttgatttttaatgaatgttctgctgaatgatttgtgatgaatttttgtctttcagtctctgcagtttatctcaatatatgaataaaaagaaggtctgttctcactgtaaaaaaaaaaa

SEQ ID NO: 255 - DNA, 163 bp, dog
cgggtaatgggatacagtttttttttttcattatctgaagaataacatgcctagaagttgataatttttcacctttttgcctcagtgtggtgaaattttcccatcttagcatcttttgccacaatttttttcattaaagtcaatttgcttcccaaaaaaaaaa

SEQ ID NO: 256 - DNA, 468 bp, dog
cctctatgcccagaatctatggtgtagcaccaggaaaagcagtatcctgattacccaccttcttgcatgcttttgtcccctgccaatgaaaggccatatactggtgcctgcagggtcttttgtacttacaggagcaatatacccttttccaagtgtactccaggaaggggaacgatccctcccagtgcaactccaggagatccctaccccactcagtgtccatgttaatactttcacttcccagagctgttatgttaagacttcctctccaatccctacttcaaggtcctccagcccacctatagaactggctgatcttagttaagaatggcgcatgcagggttctgctagcatttttccttttactcatttagcacgctggtctttttgatccagtgactatcttaccaggtttcaacaggagcctggtaccctcccctcattaaaatacaaatacaaaaaaaaaaa

SEQ ID NO: 257 - DNA, 158 bp, dog
acgcaacaactatttaatacaactatttttttaaattctcaatataaaaatttattcttcctattattttcctttaagccatgaaatgtgtttaaaaaattttaattttacatatacaagtatataaaaagacaatacataaaatgtaaaaaaaaaaa

SEQ ID NO: 258 - DNA, 183 bp, dog
gcggtgagttgtaatcactgatcagaaatcaccataacaaatataataatgatgaaaagatttgaaatactacaagagttaataaaatgtaacagaaaataagcaaatgctgttggaaaatggcactgatagacttgcttgatggaggattgccacaaaccttcagtttgttaaaaaaaaaaa

SEQ ID NO: 259 - DNA, 133 bp, dog
ttgaggtcaggtgcagtggcccacgcctgtaatcctagccatttgggaagctaaggtgggaggattgcttgaacctagaagctcagggccagcctgggcaacacagtgagaccactctctacaaaaaaaaaaa

SEQ ID NO: 260 - DNA, 132 bp, dog
catatgctgccaaagccaaaaaaaattttcaattattatgggccaatagctggagcaggttacaccttgttaaagtagattaatacaatttaccaacatttgataaaaaaaaagccttgctaaaaaaaaaaa

SEQ ID NO: 261 - DNA, 242 bp, dog
gttatagtaagttggcagtttatctcattctatccggcatcatttaaataggaaaaaattaatgttggcaaaacacaaaaacaaatacggcatgacatgaaaatacaatcttatgtttacaccggcttttcactaacatgtacctaagaagatggagaaatccattcagataatgaaattctgtttcatctagggaagttaacaggaataaatgtatggacccccccccccaaaaaaaaaaa

SEQ ID NO: 262 - DNA, 127 bp, dog
gttggtaggtattgtaaatgtctcagcattgctgctgtgtgtgctcagtgctccccttagttatactattatttgggaattgagtttgtctacggatagtagtaaaagtattaagcaaaaaaaaaaa

SEQ ID NO: 263 - DNA, 183 bp, dog
acggggtgacaatgggtgggttttctgtgggcttttgttggtttttctgtgggccctctaatggaattgatctctttggctgttcaattttttcatattgtatttttaaaatttgttgtacggtgccctgtgaacatcaagtaccaccagatgaataaaacttattatatctaaaaaaaaaaa

SEQ ID NO: 264 - DNA, 120 bp, dog
aaatcgacatagcagtattagcacagaaatgggcatcattaggcaaaatcttgaaacaagttctaatacatagtaaaacttacttaaatgacaaaatggcatttcaattaaaaaaaaaaa

SEQ ID NO: 265 - DNA, 463 bp, dog
tgcaccgacccggccagattcatcagaacaccctgatttctccataaagcctactgactgatgtccacagtttgctcaccaagcacggcgaataggcgagtccacggcctaccgtattcttctactccccagctgagctgtatggtaagcaagaataaggtttttcttgattccaaaagttttacatagttttgcctttattatcataaaggatttaatattttatagacttacaaaattatgtctgcaaaaagaaaaagttgtttttacaaaatgtaagttgactttttaataaaaatttccataaggagaattagtgaaatgtttcgctggagactagctgtgtgtaagactggtaaaagatgaggaagatataaaaggaatctaatttccgattgcatatcaaatggctttgagtttgtacttcacacacaaagaacaaacaaaatcggaaaaaaaaaaa

SEQ ID NO: 266 - DNA, 188 bp, dog
ataattagtatttaaagttactgtagtaatatgaccatgaatgaaataggttgcaaaatagacttggtctctgactgcttaaggtataactgacagttaagttttccaagactgattttagacagttttatgtatcatgtaccaatgatgtgtaaaataaagcacctttcctattataaaaaaaaaaa

SEQ ID NO: 267 - DNA, 329 bp, dog
cctctattgaatcaccctcaaaaattttttgccaagtcctaaattgatagcttaaagtcaaaagtgaaattatagtttaattaggacttggttataaagaaatcccttttccccttccccaaagggatactgcagttatatcacatacccaataggcaccacgatgaagatcagagcttattatacttaattaaggttttatacacaccagttcccccagtaaatgcaaatttaacaaaattagacatgtcatatgttcaaaatgctcatggcaaacaatcattttgcattcctgcaaataaaattgttttatactgtaaaaaaaaaaa

SEQ ID NO: 268 - DNA, 174 bp, dog
tggtcagagatgacagaaatatccactcagagtggaaaaaaaggaattctgttcattgttatttaagtaaggtgaaattattgtctagatcgttcaatatcatcacctagcagataaatttagcattctgcaatgttcctggcttgcactgggcatttaatgtaaaaaaaaaaa

SEQ ID NO: 269 - DNA, 288 bp, dog
cactagcaaatacttccaaacactgagaaataaataatacaagtaaccccagaaaataaacaaaagaatatttcgtgaacccaaaatgcactgagaggaggccacaacctgacaaagacattacaagaaagattacaaccaaatatttcctatgatcacggacacaaaaatcctataaaataggaaacccatgaataaatctctgtgtgtgtacaatgtgcttatatgtaatacataactagtgagaattgcagaagcattaagatcatttaatgttaaaaaaaaaaa

SEQ ID NO: 270 - DNA, 160 bp, dog
aactgagcacaaaattcaaagtgcagcatttcagaaaaccctgctgactctaccatcattttggaacacttagggtaaagatcattttaaactctaatggaagagacaccaggaatctcccaaaaagtcaaggaaaaatctgcaccaagaaaaaaaaaaa

SEQ ID NO: 271 - DNA, 309 bp, dog
caagtttaataaactgagatctcaaaccatacaaccattcacataatatacccaatgctaatgcagctctaatccctttaaggaagattgtgaagaggtacaaaacttccaagaaaaaaaaaatgaataaatgatttaacagagagaaaaaaacatatataatcttgtatactcatatcagagggccattcttatacatttaaactaagaagcagaataatagttttttttatttcagtggtactatttaaaaaaagccaccaaatttagaaactttctgaggactctttcagggagggagatacttag

SEQ ID NO: 272 - DNA, 141 bp, dog
gcaagtttagagagtgcatggcaacattagccatttattttctagaaatgagaggtataacttctaggacctcttcattttgagagagttccttgactaaaaaaacccaaaggctaagacagatattaggaaaaaaaaaaa

SEQ ID NO: 273 - DNA, 258 bp, dog
ggctgaccgaataatgaatgctatgtaaatgcttcactggtgactgccctgaattcttgttgtcttaaaattttatgtgatttgattattttgaaacatgttacatgtaattgtataatgttaactaaattattggtattaaatttaggatgttgttttaagaattacttgaggagatgtatttaatgtctgctttttagtagcatacttcatgttacgcttaattaaagttagccattcaagagttaaaaaaaaaaa

SEQ ID NO: 274 - DNA, 352 bp, dog
cagggcacgcagaatactgaattaagttatttccttccctgaaactagtgttctgtttcttccagctcctgtttatttcttactgccgtggagaagttaagacatgaaattcacacagccggtggctttttttcccgtgactttgcaaaaacgatattagtcctgtttaaaaaaaaaaatcaagttagcattagtgacagagaacagtccttcttttatatcgagctcttgagtaatgacctccccaagatgtattgattatctgaattttattgcatatatgcagaattctcctggctcgtgtcctctgagatgagagaaatacgtgtgcctcaccttggaaaaaaaaaaa

SEQ ID NO: 275 - DNA, 24 bp, dog
aaatcgataacttaaaaaaaaaaa

SEQ ID NO: 276 - DNA, 146 bp, dog
cgtacgtttgtaagctattgtgacagaaaagacaagggttactaattgtatgatagtgtttttatatggaagaatgtacagctttatggacaaatgtatgctgtttttgttactttaataaaaatgtagcagatgaaaaaaaaaaa

SEQ ID NO: 277 - DNA, 669 bp, dog
cctctattacatgatcctcaacctcctctcagctccagagaagacagaaccactttccaaagaaggtttgtctcagaggcagaattatttgtggctgtgcaaagcttcctcctgtctctgcaggaccagggtgagcgccctccactggtggtcttcagagcctccatctatctggtttcactctgtcaggacaaagacagagcactagatgagtgagcaagctgtgtgggaaatgcagccctgctgatgtggatatcctgcagccctccttcaacttcctgtattggagccttcatcagactacaccgagcagtcagaaaagagctgctgcagtactccttagcagtaccgccctgattgaacttctggagaagactctggcactcacctggaccaaggtagactctcccaggactgaactcctttgctccgcctggctgctcactgcctctttctctgctcagcagcactatgccagtctgcaggaccttgtcatcatagagccctgcaggaggtcgtctgtgggctgctccacattcaggtgtctccttcctcagcctgactgcaccttgtggatagaaaccatcttctagcctttgaggttcaccagacactgtccgtggatctggaccaagtattgaaggtcctcagcttcccaaaaaaaaaaaa

SEQ ID NO: 278 - DNA, 548 bp, dog
tcaaagatgggctgataatccggaagcctgtgactgtccattcccgagctcggtgccggaaaaacactctggcccgccggaagggcaggcatatgggcattggtaagagaaaaggtactgccaatgctcgaatgcctgagaaggtaacgtggatgaggaggatgagaattctacgcaggctgctcagaagataccgtgaatctaagaagattgaccgccacatgtatcatagcctgtacctgaaagtgaagggtaacgtgttcaagaacaagcggattctcatggaacacatccacaagctgaaggcagacaaggctcgcaagaagcttctggctgaccaggctgaggcccgcagatctaagaccaaggaggcccgcaagcgccgtgaagagcggctccaggccaagaaggaggaaatcatcaagactctgtccaaggaggaagagaccaagaaataaaactccctctctcttgtctgtacatagtggcctcagcatgaatcagatcagttattcaataaaacaaacctttatctgcaaaaaaaaaaa

SEQ ID NO: 279 - DNA, 171 bp, dog
tcctggaactatgtgaataataaacaggacagaatcatttgtctccttaaaaatagtgggcctcataaagcaaggcccttttatgattttcttctcccaaatagttggtaaaattcgggtatttcttgcattctccttgccccataacagatgtcactttaaaaaaaaaaa

SEQ ID NO: 280 - DNA, 615 bp, dog
gttgtgcatatgtgctgtttactttccactgttatcatttttagtagggtcttagagaaattcatgtgctctgttcaccatcaactagaaaattctcgcttacttttttgatattactgctacttataagcaagcaaaacacccaataaacattagagttgaaaatatgaaaaacaaattgtcttcataaaggaataattttggctacagctggaaaaaacatgctttgagatgattcataattttgtttagagaaaaaagagaagatctgaatttaagcatttattatttattttcattacctgagcattccataattttttagcccaaaatgaaaacaaacttagcagttgacacctatcattattttctctatggttattatttttctgtctcacagagggtgctggatctttgcactggaccgggggttctgcagctaaacctggaaaaccaaagggaaagaaaaaactttcttctgttcgtcagaaatttgatgtaggttgttactcaatagatcttggtaacaactgatttaaatgctgatgtgatgaaactggccttagtttttaaatacatcttaaaatactagtagtagagttggaaaaaaaaaaa

SEQ ID NO: 281 - DNA, 162 bp, dog
agaggcagcaaaagaagagaaataataaaaaccagagcagaaataaataatatagaaacaaacaaacaaaacaatagaacagattaatgtagctaggagctgggtctccaaaagaattaataaaattgacaaacccctagcctgactcatgaaaaaaaaaaa

SEQ ID NO: 282 - DNA, 200 bp, dog
atgaaggagtgaaatgtaaaagaaaatctcttttgtgaaaattccagaaaaaggaccctagtatctactttgggttttagcattaacttcatgcaaagcgcacaaaaatgaaatagctgaatcctccagtatcccaagtatcttgtggaagtttatgaagttcttagctgtggtatttctgccagtgggaaaaaaaaaaa

SEQ ID NO: 283 - DNA, 90 bp, dog
cggtcctggtaattgttaataaaacgctttggttgtgttcggtctggttgggaaagctttggcaaggatttctggctctaaaaaaaaaaa

SEQ ID NO: 284 - DNA, 217 bp, dog
acgttagcagagaaacactacagggattatactatcttcatagtaaaggaaaaatgcacagagatataaaggtatacatcatatgtttaagctaatgacctcttttcatttttaaataatcaaactgttaagcaatattgtcttaatctatttgatgaaatttcttacctaaaatatgttactataataaaattgagtgatactttaaaaaaaaaaa

SEQ ID NO: 285 - DNA, 416 bp, dog
tcaaagagataatggttgataatttttcagaactaatgaatcgtacatcttcagactcacgaaatgtaaggagcctgaaaaacaggataaattaaaagatatccacacctagacatatcctagtaaaattgctcaaaaccagaagaaaagagaagatcttaacagcacccaaagataaaagatggcttataaaagagcaataataggctgacagtggtgggctaatatattacatcagagtgctgagatgagttaactgacaactggaattctttctacctagctaaattgtcatttaagtgtaacataaagacatttgcaatgcctgggagaatttactattaacagaaccttgctgaatgaacttctaaatgcattttaccctaatgagaaaagatgaagtgcaaaaaaaaaaa

SEQ ID NO: 286 - DNA, 268 bp, dog
ttgaggtgacaacgaaggggtaggactggaatatgctaaaacctgcagacttcagaaggtctggtgggcagggaaggcagagggagggagaatgaaaaaataaagttttggtgacggaccatttgtgcctctgtggcctgcagctcacagacgctaacgtcttggcccagccttctcatttttccttaattatagactctgcaagttgtcagagcatcctaactgttggttagccaaaagcatctttttaaatccagaaaaaaaaaaa

SEQ ID NO: 287 - DNA, 139 bp, dog
aacgagggtagagatttggagtcagggaatcttattgctgcccatgaactgatgagatcatctggtccagctggctgtattaagtttcttagagtcctttgaaagatgcatgtacttagataaaatgcaaaaaaaaaaa

SEQ ID NO: 288 - DNA, 247 bp, dog
agaggcagtacctgaaattggcttttaataactttggcacaagtgaagggaggatttcccagtaactgaggacaaattctagatctggacattcttcccaacataaaaagccctgggaaaattcttttgatgattcagagagtaatataaacttatgacacttggaaagattataaaggaaaaacttcctgcaaactacagtaagttgacacacgttttctgtaaccacattgttgaaaaaaaaaaa

SEQ ID NO: 289 - DNA, 468 bp, dog
agttatccctattgtattaatctgtaattagtaaacatccaaaaaaaagtttgaggtactaaattatgtcctgcctctatgatgtatatgtttgcttatgattatattatttataagttgcttggctatttctctcccttgctttctgcctaactgtagagtaaccaaataaggcaaatggaagaagtaaaaatctcaaagaagagtaaagtaggaattcttccatttgttgctgaatttgaagaatttgctggactcgcagaatcgatttttaaaaatgctgaacgtcgtggagatctagataaagcatatactaaacttatcagaggagtgtttgttaatgtggagaaagtagcaaatgaaagccagaagacccccagggatgtagttatgatggaaaattttcaccatatttttgcaacactttctcgtttgaaaatctcatgtctagaagctgaaaaaaaaaaa

SEQ ID NO: 290 - DNA, 217 bp, dog
gagtgctgtgcctatttatttttgcatccgtactggatatactgcctgacacactgcaggcattcagtgacttctagttgaatcagggagtgaaaatgtgtgggaaacaacctgagtcaacttagtcacttagcagtgaatgatacagcccagggatacctcaggagtattttctatatgagaaagagaaggattcgtatgtcttgaaaaaaaaaaa

SEQ ID NO: 291 - DNA, 150 bp, dog
ttgatcctaactgggacagcctagagtgaaacataatctatagaaatttttggaaggtcggtgggtcctcaaatgctccccatttaaagaaattaaacttctaatgtcattcctagggtttagagctattcttttattgaaaaaaaaaaa

SEQ ID NO: 292 - DNA, 207 bp, dog
gcaagttagatggtgagatcatacctcatttcccagggaggaaataatgccggccatacagttgttgtagattctgtggaatatgattttcatcttttgcccagtggaataattaatccaaatgttaccgcattcattggaaatggtgtggtaattcatcttcccggattatttgaggaagcagagaaaaatgtccaaaaaaaaaaa

SEQ ID NO: 293 - DNA, 283 bp, dog
cctgcaataaaaggctatgtactgaattttagaggaaactgaaatgtaggaactcagtacaatatcatgctatgttaaaacattgattatggcatttaaaaaatgttaaatatcatgtcaagtgttcacacacacacacacacacacatcccccctgtgggatgaccaaggtttcctattgagtttatacactgagtcaaagcaaaagtctcactttttccagtaaaaaaaaaaaaaagtcattaaattttgccttaagagttaatgatctgaaaaaaaaaaa

SEQ ID NO: 294 - DNA, 121 bp, dog
ggtgaactacggttaatccaaccaactggcacatttttctaaaatcaaaagggaaacatttagaaatcggttgacagccactcataaaagttcatccccccgcccccgccaaaaaaaaaaa

SEQ ID NO: 295 - DNA, 135 bp, dog
cgtacgtggtcagggaaagaagatcaatgaggtataaacaacttccaagcaaactaggcttgagtgtgggtgtgtttggctttgtgttacctaatgatgtaagagataaatctctttagttaccaaaaaaaaaaa

SEQ ID NO: 296 - DNA, 150 bp, dog
ttattcggcatattactggaagtcatggtcacggctgtcagacaagaaaaaggaataaaaggtcagtaaggaagaagtaaagctttcactatttgcagatgacgtggtgccgtatatggaaaacccaaaagactttgccaaaaaaaaaaa

SEQ ID NO: 297 - DNA, 202 bp, dog
accaggttgtagagcactaaggggtgacctagaaagtggtgtagcaaacttgaaataattaagagtctgttattcttgtcaacgaagtatgtgatatatcaacatatttcttattcaactagctatcactcctccagttatttcatgtactctaagtgatgctttctactttttaaccacttacagaagtgaaaaaaaaaaa

SEQ ID NO: 298 - DNA, 145 bp, dog
tggtcaggaaacctcacttctttaggatttaagacttttcttatttctgtcaaacccattcagagaaatcatacaaacccttgactgctcctatacctaatctgctctccagggcatatgcagagagatatctgaaaaaaaaaaa

SEQ ID NO: 299 - DNA, 30 bp, dog
gcaagtttaaggtgtatagaaaaaaaaaaa

SEQ ID NO: 300 - DNA, 131 bp, dog
gaagcgggggtgggggggggaggaaatagcaattaagttaggcaatcctatctccctcctgaagtcatctccctaaactccctttttcttgaccataatctattttattagtggtttctcaaaaaaaaaaa

SEQ ID NO: 301 - DNA, 149 bp, dog
gctgctccccctggttgtgtgctctgtcaaataaataaaatcttaaaaaaaatataccctcccccaataagaccatttaagtgtgtcttaactacagaatactaactaaaaatgttggccaagaccaaccccccccccaaaaaaaaaaa

SEQ ID NO: 302 - DNA, 240 bp, dog
gtagtaatcttggtgagaggtgatagagcttcagatcgggtgatagcagtataagtgctatgaactggttggattctgaatatattttaaaagtagagccattaggatttcctgatgaattggatggaggacatgaaagaaagataggagtcaaattaacttccagggttttggaactgaataactcgaaggatggatttgcattcaattaagatgggtaggttgtaccaaaaaaaaaaa

SEQ ID NO: 303 - DNA, 203 bp, dog
ggctgactaggtgggaactgtggggatccaaggtcaagaaacctttttcttatgatttgtagctacctactgtgcctgacttggtgcctgtgtgaggatgaagcccttagctgctcttgcaattattcacatgactgaagttaaaagaacttgcttttgtaataacaataaaaattgtcatattcttttttgaaaaaaaaaaa

SEQ ID NO: 304 - DNA, 146 bp, dog
aacgaggatgaagattcaccaaacaagctctacacgctggttacctacgtacctgtcaccactttcaaaaatctacagactgttaatgtggatgagaactaatcgctgattgtcaaataaaggtgtaaaactgttaaaaaaaaaaa

SEQ ID NO: 305 - DNA, 224 bp, dog
ctcaacggtactttatgaaaaaaattgttttgtggccactcaacttgggaagcattgcatcccttataccccatggaagttttataatactcataaggctgttactacaagacttctgagtataattttaaacaattttgtagttctttttgtctctaggacataccccactagggatatatggccaaatacccatgagaaaaactactcttcaaaaaaaaaaa

SEQ ID NO: 306 - DNA, 204 bp, dog
tgagactatccggtgtcatggttttcaaattaggaaaaaatccttatcttaaataactctaatatacttgagtcactctctcatgttgcctcttaacaataaaacgttaatgttcggtaagtgaaacttaactcttgccagtggaagggactgtttatgttatagagtctctcatttaatcttgctctttgggaaaaaaaaaaa

SEQ ID NO: 307 - DNA, 179 bp, dog
gattgccaatcgaccagatggaagcagccggccagctacaccaaaaatatcgacacaggaaatgaaaaacaaaccttcacaaggtgatgcatttaacagtcgagttcaggacctcatcagcttcgtggtaaccacaaatcacaccaccacaaagagtcatcagatcacaaaaaaaaaaa

SEQ ID NO: 308 - DNA, 259 bp, dog
caagaccatatttatccaagctgttttgggaatactccagagtggaatagttctaaatttataagtctttggggatcagaagtgatgaatgataagaactggaatcctggcactttcttgccagatacaatttctgggagtgacatactaggaccaactctctcagaaacaagacccgaagcccttccaacgccatccagcggtgaaacacctatggtttcagagagcaaggagaaaaaaaacgctgcaaaaaaaaaaa

SEQ ID NO: 309 - DNA, 385 bp, dog
cccatgagccacctaaccagcaacttcttttccagcagatctcagcttaacagcctcaaatctccccgaccacccaagctcaagaaggatctccccaccaacaccttgctcttctcacctaatgtcgcttttcactgtgatcacacttcttgcaacatgtgctgatccatttaagagcaggctccagactgaggtgacaccatgagaaagggattatttcggttctccggtatagccgcagtgccagcgtggtgctgggcgcattcgggcttgagaagttgttgctgaacaacagaatgaatgcatgatctacttgcctgtaaagaaagtctccaaactgttcctgtttttcctctaaccctattaagctcacaccgctgccctg

SEQ ID NO: 310 - DNA, 308 bp, dog
ttgatccagcagggtaggattgttttgatttctctctttgtagctttagcattttgagaaagcaacttacctttctggccagtgtctgtatcctagcagggagatgaggatttgctgttttcagtgggtctatgtgtgcatctcctttttcttccaggacttgtaggattctttgtgtaatttatgtataatttggtgggtgctgatttttaagaaccctatgaagtgctttttgtatgtgcttagaaaagacatttgaaaattgaaagtgtgatttatgggaacgaaatcatctgtaaaaaaaaaaa

SEQ ID NO: 311 - DNA, 55 bp, dog
atgcccgggagtaaattctgcatagaataaatgcaaataaaaataaaaaaaaaaa

SEQ ID NO: 312 - DNA, 231 bp, dog
gtctaaaggttgggctaagtggtcccggactacagactctgttgccttgaatataacagtacaatttgtcatttactctgcaccaggctaaactgagtaaaaatctatttgaaggtatcttgtttgtaaacatttgtcagattctaatttttttctttttgtattaaaattcaactatggatgtatatgaaacaaaataaatggagatcatttttctcccaaaaaaaaaaa

SEQ ID NO: 313 - DNA, 391 bp, dog
caagtttggggtcatattgtgctatttgttgtctaagcaatcaatatggaatcacagctggacaatgtgggcaagccacctatggtgaaccatacaaggacccttactgctattgtgtatttaggacatgagtgtgcggcttgtgaccgcttgtgagctaattctgaacccttatcataatgacttccttgataatcaagctggggttaccataggacataggttagttcttaacataatttaccttcttagaccagtactgatgaagacccatgttaatctgaatattatacttcagctaattaagttcaaagagattccatttatttgagtaaattatcccattatttttgctaactaaatgcattttgaaaagctagaaaaaaaaaaa

SEQ ID NO: 314 - DNA, 249 bp, dog
atgcccgatgtgtgctgaaatcttgcatttgttgcctttggtgtcttgaaaagtgcctaaactatttaaatcaggtaaaatattttaaaaaataaatctaacattcactttcaaggataggttcatcatttcttcttccaagataaaataattgagcttacttgaaagatgttacatatttctcatgatgttatacattgtggcttattcgtgtatatctatttctatcatattctttaaaaaaaaaaa

SEQ ID NO: 315 - DNA, 422 bp, dog
cgactgtaccccaaggaaatagggttctatgctggactctcacatgtcccctactcttcgtctgttcctgtaaggagtagaatattaggaactctaaagccaaatccatggcttcatctgtaaaatatacctattactatcaactttacaatacccacttttatgaaaattaatggagtgacaaatgtatactacctagtaggtgctcagtatttcctagttccatcgctcttagcctcaagccctattcatgctatggatagaatcagtggaagaggaggccagttgcatttgttctagatgaaatacatcagttatacctttggaaatagtttaggtacccatgaagatagacactacagtagtcatctaaaacaattatttcttccctctgatttaaccccatgtgggaaaaaaaaaaa

SEQ ID NO: 316 - DNA, 274 bp, dog
tctctggagatggacgcaattacctccttgcttttcaaaaaggaattagaaataaagtctatcaaaggtattatttattaggaatacttgataatgctatcatgggcaggggtgaaggaaaacagcaccagataagctagttttttaaagtctaggcttttgagatcagtgagtaaacttctttgaagaaaatacttgtttcattttagccaacctcttgaaatatgattcttctaattagcttttaaaatgatgctattctgaaaaaaaaaaa

SEQ ID NO: 317 - DNA, 367 bp, dog
tagtccagtattactagagatttttctgaacactataaagggcatttaggggaacacttctgggcaatgtcttttccaatcttatttaaggtctgggaacttctttccagggcagacaaaccagctctgaaacaaagcacttggtgatctttagtttgagatgtctatatgatacttctgagttacattaagatacaaactgcagataggataaaaatgaaatcaagatataactcattgagattggattaaacaattattctaagaatttactatcttttgattgtttcaccaattccataaattctactgattaagtattcattttaatttttgattaaatgaaagtttgaattaaaaaaaaaaa

SEQ ID NO: 318 - DNA, 233 bp, dog
cgacgctaagaagaaataagaatcatacagattgagcggaaggggaacaaaggcacagaggctttactggggttcactgtatgtgtgggattgccttccttcatctctgtgttgtggcataaggctgattctcctgactttacagaatgagccctagaagcagaatcctgggtcccagcttatgcatgttaacaatcaagaacaccacattttctttttcttaaaaaaaaaaa

SEQ ID NO: 319 - DNA, 179 bp, dog
tcaaagaccataaataatctgcgaaactataaaaactataaaaatagagtaaatatttttaactagattatgattaagaggtagaccttatgttacacacacaagtacataaatggtgacaactgagtttttgaaaatcaagtgattttgatatgcaacatgaactgcaaaaaaaaaaa

SEQ ID NO: 320 - DNA, 152 bp, dog
tgaattccatctagctctgtgttaatccctgttattactggtaaagcttcatttgaatatgtaaattcagtttaggctatgtaaaatttttgctaatgtcatcattctgaaaaaaataaatttacaaatacattcaaaattaaaaaaaaaaa

SEQ ID NO: 321 - DNA, 292 bp, dog
gcaagttcagacagttttgcatctactcagcccactcattcatggaaagtaggagacaagtgtatggcaatctggagtgaagacggacagtgttatgaagcggagatcgaggagatagatgaagaaaacggcactgctgcaatcacctttgctggctacggcaatgctgaagtgaccccactgttgaacctcaagcctgtagaagaaggaaggaaggcaaaggaggacagtggcaacaaacccatgtcaaaaaaagaaatgattgcccagcagcgtgaatataaaaaaaaaa

SEQ ID NO: 322 - DNA, 337 bp, dog
ctagcatccatctgattcacaaacacacactgtgaagggaaatcattttcatcactgttcaaagtcaggaaggaaataaatcgacacataaatattctagatttttaacgtctgtgaggtgtttttagtagatggaagttaaatgactaatccccttaaaataacagataacagaccagggtcctcagggttctgtcttatttaggatagtgtatcgatttgcttcggtgtttctaatttaggatatcatgtaggacttaatattaaaattcagtttcctgatgactgattgagatggaagtttcatcttggtataaaattttaccaaaaaaaaaaa

SEQ ID NO: 323 - DNA, 763 bp, dog
cactagccaaagagaagaggggacatgtgacaccaagtttgagatttatcagaaacctttcattgaaaaaagatgggagatgcacacacttgtctgagggacaccagatggagaaaatgtgtatatatattgatgggcttttccattggtgtctgctctatgaaaaagacaaaagtagagaaagaaaggaggaagaaagatacaggaagacaaaagtgaaagtgaatatgggtgacctaaggctttggctgcctccctaggaaatacagaagaagcccgttcatcttgtctctgttcaaaattagaatgaaaaggttcagtaccctatggagtggaaagtgcagaaaattcaatcctatgtttcacttcagatccaggctattgtcactgctgagtagcagagaaaccagaagcactgagagtctatgagaaggtgagactttccttttgggtttggggtgtgcaaaaaagtatagggaagtggcacagaaaatattaaaaccccagaacaaattcagtggcctgtcttctccaaagggcaataggaactgatgctgtttcttgaagaccttttatgcctttagagatgaagtggcattggttttagattgacctcaaaatccccctcttccaggtatgggtatcccctgcctttcacaagttgacatttcaccaatttgcttttaccaaagacctacattagcacccgtttttgcttactgaaagaaatccaaacaggatttttgcttttgaaaaaaaaaaa

SEQ ID NO: 324 - DNA, 204 bp, dog
gattgccccaaggaaggaaggaggtgctctgaggcataattcactctccagagctcccctctggatcaggccaagactgagacttcccacgatatcacacctggctcagcctcttctgtctccctgtcctccttcttctgctcacctactggtgtctcctggaagcctttccttaataaagttcttgtgcctgaaaaaaaaaaa

SEQ ID NO: 325 - DNA, 764 bp, dog
tgcaccgttgatcactgcaatctccatcagccctgaaataatgaagtctgttacgctgatatttttcccgttgcccgcttgcctgaacccagtcctctatgttttcttcaacccaaagtttaaagaagactggaagttactgaagcgacacatcaccaaaaaaagcggctcggtgtcagtctccatcagtagccaagcaggctgtgtggaccaggatttctactatgactgtggcatgtactcgcatttgcagggtaacctgactgtgtgtgactgctgtgaatcctttcttttgacaaagccagtgtcctgcaaacacttaataaaatcacacagctgtcctgcgttggccgtgggttcttgccaaagaccagacagctattggtctgactgtggcaccgcaatcggcccactccgattatgcggatgaagaagactccttcgtctccgacagttctgaccaggtgcacgcctgtggacgagcctgcttctatcagagtcgaggattccctttggtgcggctatgcttacaatctaccacgagttaaagactgaactgatgtgtctgtaactgtttccccccccatgaaccaaaatcccagcatttatagactgaaccctagtctcatctttcatctgggaagcacttctgtgatcactgcctggtgtgtcacttagtaggaggagagggtggcagtttatttcttaaaccagacgttttcgaagaacaagtgcctaaactgtcaatcgatgaaaaaaaaaaa

SEQ ID NO: 326 - DNA, 246 bp, dog
cggtcctccaggcttgcaatattcttttcatagtggatttgcaaaaaaaaaaaaaaaaaaaaagttctctggaaacagagccaagctaaagatgacatgggaaatgtgggcttcgctctggagtttatgaatataatagaagtgattctaccaaggagactataccttctttgtagcaactttaaaatctgtacctaaaaaaaaaaaaattaataaataaataaaatctgtacctaaaaaaaaaaa

SEQ ID NO: 327 - DNA, 324 bp, dog
tctctggattagttctatccatgctttgcccctgaaatcaggaaggaccttgtcagtaagggactgcttttgaaagttcttttgatagccacccagcaccccatgaacttaacaccaaaggcatcaaagtgacctccttgcccccaaccaaatgtccctaattcagcctctagatcagaggatctttagaactttaaggctcattacacatggtactctaatgaaaagattgtctacattatggaaggaaacccttgatagagaacatcacgaaagtctggaaggattataccattgaagatgtcatccttataaaaaaaaaaa

SEQ ID NO: 328 - DNA, 226 bp, dog
tcccagctctgcccttagaatcccaccaagctgccactgagaatgccaaaagacaggtgaaaaagaatgccaccattctggttctcttctgctcttacattcccatatcaaaatcctaagtcttatttcttgctaaggtgttcacatggaggtagatagactaaacatgaaaggaaaggaaaagatttctcaggacatctcagtaggtctcatttaaaaaaaaaaa

SEQ ID NO: 329 - DNA, 370 bp, dog
ccacgtagctagtcttccttcacttgttaccagtgcttcccatgcccatcaagcacacctaccttctacaaccagtataacttacttcctttcatctcctggcttagagctgctgctgagaattgtttttatttacctttatgaccttttatggttctctcctgctactctagaacccttctacagtgccagtgccttttgccattgacattgggattggctgggtgttattattggttgaaaattctgctcttggggagcccagctggctcagacagtagagcatatgactcttgatcttgggatcatgaatttgggggtagtttacttaaaaagattctgctcttgttccatcctttaaaaaaaaaaa

SEQ ID NO: 330 - DNA, 137 bp, dog
ttgaggtcacatagatggttttgagccttgctgttaataagacgcagtgaagttttcttaatttttatttgtttctaataaacattcatgagctattacctttacctgtcttacactgcattacttaaaaaaaaaaa

SEQ ID NO: 331 - DNA, 477 bp, dog
cactagcctgtgttaattccaaccctggattatcctgatgatctcttttcaccattcctcttcctcaatttcctcaaaaatttcctccaaataccactaaattcatgtttttcaaatctcacctggaaccacagtcttgtatagaaatgctctcactcatcttgggtcagtccccctccccttccttcctcccataaaggtcacacccagctctgcctacactctcccttacacttctagtaggcaacattcctccccgagttgacagaacagatgccgtccaataatttccctctactcttttactaaccttattaatgtctttacggtctttcagaagagatgttttcacttctattaagataattccttcccatgccctatagtctatctcctcccttctccagaatgtccctctattgtaccttctacccttgtctttcttctgtttctactatttagcctgaaaaaaaaaaa

SEQ ID NO: 332 - DNA, 151 bp, dog
aacgaggacagcgtttccatttgggaagacggcgttctggagacggacggtgccggcagctgcccagtgtgcttaacgacactgaaccgtacgccttaagatggtgagatttatgtgcagtttggtacatgtgaaagtgtaaaaaaaaaaa

SEQ ID NO: 333 - DNA, 145 bp, dog
cagggcatggtgtacagcaagaaataacagtctgacagcaagtatcagagccagactcacctatgacacagattttggaattagctgatgggcaatttgtttgattaatgataatatgttaaataatctaatggaaaaaaaaaaa

SEQ ID NO: 334 - DNA, 117 bp, dog
cctctatcatccttccctgttgctccccaaagcactttttatagctttctctggttcaagttaaccaacctctacaaataaaacttgacagaccatgacttcttctcaaaaaaaaaa

SEQ ID NO: 335 - DNA, 304 bp, dog
tcatatgccccacccatgacactgtgccccacactctcctaagagctctctctagagagagccatctcctgcaagtctgttcttctatcctctcatctcttccctctcctggatgctggcaaaacctcaacatttcttgatttccaagagctttttagtcttcttttgtttcatccttatccatccaggtcagacccagcgatctcatctcttagcactagggatgctcctgtagttgtgagaaacaacaaaagcacagttctcccactaagaacaactctttctcctagaccaaaaaaaaaaa

SEQ ID NO: 336 - DNA, 194 bp, dog
ttattcggcaggggacatagccttttccatgctttggaagtccagggaggtttagcagggagagacacagggggctaaggtgctcagaaaggtagaggtttctcttcaaaaccttagcctaaagagcgctgtcacttttttcctctcccatcattttttccaaataaaatttgccgagttgagaaaaaaaaaaa

SEQ ID NO: 337 - DNA, 259 bp, dog
atgaaggggcacctgtgcatattgacaactttggttttcagcctcatctttaatgcctaaataaactaaacataagcctcccagtgatgcccccatcctgtacgtggtctctaggagattgtatagagtctcacattagatccatttttagctgtggctgacatcatgctaaactatttgcatgcaacaccacatttctctttcaaggtctttgaaagatgtaagtcacataataatcttcagttgacaaaaaaaaaaa

SEQ ID NO: 338 - DNA, 206 bp, dog
atgcccgtgttggcacattggaaaagagtgactttaggaaatcttaaacccattcctctgatttcagctacattagtcagctcaaaggaaggacgttggtggttaggattattgactaatgatctatatccagtgtcccaagctagtgacccatccaatttacagacagtgttttgtgtaatcttcctgttgtttaaaaaaaaaaa

SEQ ID NO: 339 - DNA, 323 bp, dog
agaggcaatgacagcaaaggaaacaaagagaacaaatttgatgttttaaaataaaagtagttgaggttggaggttggaggaaagaagccatctaccagcccaagagagcagacataaagagtggcctgatccccagaggctaccagaactggtgcacactgtttgcaaaagactgttttaccaactatttatttggtttatatgagggaaaattcagtaatttaatgctactttgacctttttgaaatgaaactggagcagtttcaggggaaaggagaatcccattaaaccttcaaactaataaaatggcttaaaaaaaaaaa

SEQ ID NO: 340 - DNA, 225 bp, dog
ctccggagaacgggtatttgatggaggctgcaccagagtgaagggggcctcccccactgttttatttggacgtgttcctacccacccatttactgtcatcctctcccccaatcttcttggccaccacctaagtttgccagccaagggtaggagtctcccttatttgttctggccccttggatttaaaaataaaattaatttcctgttgataatgaaaaaaaaaaa

SEQ ID NO: 341 - DNA, 146 bp, dog
cggtcctcacggtgtctactaacgaccaacatttgctaatgtaaataatagtaaattattgagaatcctaattcttttacacagtctgttttttaatctattttaattaaataaagcatattactctacccgtggaaaaaaaaaaa

SEQ ID NO: 342 - DNA, 680 bp, dog
ttgaggtataagaacacaggcctgcctggactgaggttgaaccagggcaacagataaaagtccctgtctctcaccatcaactgcacaattatctggtaataagcaatagcagagtatcacacaggaaaaataagagagcggagagaccacatgtgtggcataaacatgtaagtaagaacgaaagttcaggatggagcaagaaccatgagaaaatccttctgactcactgctaaagaaacttgaagctttttatgttctgcaaatagtaatagcaaaatagacagatagataaatagataaacaaaacagctaaaaccttgtactaccggcctgaaagaagatctttgttcatatcagacataaatgctgtttttttcagtctctgctgtttgatacattatgatccatgctacatgaaagattacatgacaaaaaaagaaagaaaaattggaaaaattcacccattctaaagaaagctgtaaacagagtcagacaaagatatgattcagatgtctcagttatcagactgaactttaaaataatcatgattaatatgttaaagaacccagtagaaaagatgtgcaccatgcaggaacaaatgaataatttcaacagagaggggagttaaatgaaaatgatagaaatgaaaggaaaaggtaacagcagtggaaaaaaaaaaa

SEQ ID NO: 343 - DNA, 221 bp, dog
cgtacgtgtttcccttgccattcaaagtcgttgtgaggaaaaattaaaatgttaaatcactagcatgcatcttacgactccttgggattctgtgcaatgtgcgttttaagtgcaacgcgttcacgagcagaatcccagaaatcacacatctggtattttgtagctcggatatgcatatgcatttcgttcttcctcaaagtacatgccacgaaaaaaaaaaa

SEQ ID NO: 344 - DNA, 191 bp, dog
cggtccttctccctcctgaataaggtgaaaagtctgtctttgctgcaatgttgttgactctttaatgatcatatatttcagatctcagtgggaaatggagaagcataatctggaaagcacaattaaaacatacttaaacaaactgaatgcagaaactagcagagctttaacagctgaggtaaaaaaaaaaa

SEQ ID NO: 345 - DNA, 274 bp, dog
ctcaacgtaataaaagtcatatgtgaaaaacccacaataaacatcatactcaatggtgaaagaccaaaagctttttctctaagatctagaacaaggcaaaaatgcctgctttcaacatttctattcaacatgttactggaagaccacagcagttatgcaagaaaaggaaataaaaggcatccaagtttgaaagaaagaggtaaaattatctttggttgcagatgatatggttttatatgtagaaaaccctaaagatgccatacaaaaaaaaaaa

SEQ ID NO: 346 - DNA, 363 bp, dog
tttttttttttaaagaaagtaattatggaactagatttttaacattgtaaaatactaaatgatccttcagttgtaagttgatgtatatttgtaacctttgtgaaattgtatccttatgaaaataccacttttgtagaagagagaatccaactatgtaatatttaattaaaacaatccatgtttaccctatccctgctcaattaaacagtgtatataggtctaataatagctctggagcaacttttatcatgagtcaaatatattaaacacattgatgtcttcttggtatatctgaaaacaagaggtagaagtcctgttgagagtctttaaaataaactatttttacaaatgtaaaaaaaaaaa

SEQ ID NO: 347 - DNA, 257 bp, dog
ttgaggtggagagttctttgttaatagacattgcctggcatattagtaggtattcaatttatatttctacctaattaattttttaagtttttaatggcagtgtgtgtgtgtgtgtgtgtgtgtgtgtgtgtgtagactgtttttgatttggaaataaaatactataccttttcagaagtagagttaggagactatgagtaatataaatatgagctgtcatttaccaattactggtccctggtgctgaaaaaaaaaaa

SEQ ID NO: 348 - DNA, 454 bp, dog
accaggtaggaatacatgagcctcagaaattttatttataatcaataaatacaaaatatctatgaattgatataaatatgctataatataaaacaccatagttcctaaaactttagcaattatgtaactttagctaagtagggaatatttgtagaatattttaaagttcaaggtagttctcaaactttacataaggaattcattcaagagtggatttgtctgtagttgatactatgtgagaggttattcacaaatactcagaagtcaacttccaagaaaaaccttatattacctagaaacaaacaaaaaaaagatagcaatttgccagtaagttctgctatgatctttgatatccttaaacaaaacaatttctctatctttatcattccaaaaatttagaaattttagaagaagttattattttctatgcattccattctgttaaaaaaaaaaa

SEQ ID NO: 349 - DNA, 280 bp, dog
gccatggaaatcaagtacacagagcagtgtcattccagtcctggtgatgcctgcagtagtttatccctttgttgttcttgtttcttaagcaactgcctcgcattctttcatcattacaattaatcatgcacacaagtttttatctttcatctcaaatagaaagtactaaaaatgtctgacaaaaatagggagaatttaaatattcttgtggctttaaatatgcatttgcgattttccccctcagtcccattggaaaataggtcatgtagaaaaaaaaaaa

SEQ ID NO: 350 - DNA, 180 bp, dog
acggggtgatggaaatgtatctcctgatgatggtagagattatacaactacatacagtagtaaaaaatcattgatttacacacttgaaattggcagtttattttatattcattttactttagtaaagctgacaaaaaaacagactattaatttgacaaaggccgcctacaaaaaaaaaaa

SEQ ID NO: 351 - DNA, 204 bp, dog
tgagactagttagatatttatggaaaaattataagaagcaatgtgaattttaaaaaaattcaaaaatagatattggttaggaaaactagactctcactatttggtaatgcatattctgactcattcacacagacattgtggtacctaaagtgttgcaaaatcggacatttatatggagatgggctattgatgtaaaaaaaaaaa

SEQ ID NO: 352 - DNA, 296 bp, dog
tctctggccatccagaactttcccccagactgagtctcctaaaactgagatacacaataaaaacatgattatctgttggagagaaaaacatgattaaaaaacatgagtctgagtctcctaaaactgagatacacaataaaaacatgattatctgttggcagtgttcagtctaggactgagtccctaggaaagctgatcaactttgccttgttcccatattctctttggaagttaacatttaatacaattatcagtactgattatgcaactatttcaggctttctgaaaaaaaaaaa

SEQ ID NO: 353 - DNA, 317 bp, dog
tcaaagacaaaaacaaagatctttcttttagtaaaatggtggtggtgcttctcttctcttctctctctttttaaagacgtgataatcagtcaggattcactctgtttatagtttgactacttcatagaaaaatgtgtctataaaacacctggtagttgtaaaaaggcttgggtaaggcccagggagctggataaatatatgttatttactcagctgtcccaagccatcaccaatctccttacacccaaggactttctgacctctcctaaatttcatttctaatgttcttgctacaaagttaggtgcaaaaaaaaaaa

SEQ ID NO: 354 - DNA, 225 bp, dog
cgggtaaatacttgagattgcttagaattatattttcctgcatctaaataacatttgtgaactgatcataaagattcttaggagtaataatgcttcagagagaatagatcatatattgtatttgtgtttaaatgtcagtccataagccagaaacagctatttacaactgagggctctgtagagttcccatttacaacatacattaatttcagggaaaaaaaaaaa

SEQ ID NO: 355 - DNA, 233 bp, dog
gttatagactttgcatcattttcttacctttctctcagccactgtttcctcatccattaaatagggatattaataccacccactgcaagggggtgttttgagaacaaaatctgataatgcaagtgaagtctattgtgcagtgcctttcaacagtgaccattcagcaaaaggctagctctaatgataactaatagtaatattcatataaaactcacatgtgtgaaaaaaaaaaa

SEQ ID NO: 356 - DNA, 412 bp, dog
ttatccgtgccgatagcgctctcgcaaagatggtgaatgttcctaaaacccgccggactttctgcaagaagtgtggtaagcaccaaccccacaaagtgacacagtacaagaaaggcaaagattctctttacgctcagggaaagcggcgttatgaccggaagcagagtggctatggtgggcagactaagccgatcttccggaaaaaggctaaaactacaaagaagattgtgctgaggcttgaatgtgttgagcccaactgcagatcgaagagaatgctggctattaagagatgcaagcattttgaactgggaggagataagaagagaaagggccaagtgatccagttctaaacttcatattttgttatgaagacaataaaatcttgatgttacgttcacttcaaaaaaaaaaa

SEQ ID NO: 357 - DNA, 232 bp, dog
aataacggtaccttgaaaaatttagcatatctacaactattatttaaccaaaatttggtcttcattgacatttatcatttaaataaccctggatggcaaaaaacatgtttactctgtgctatgtataaaatgaaactccatgatatagttcctgctctcaaggagctcacaaattacttaataattgactgaaaaacagactatttagttaactgttgtggaaaaaaaaaaa

SEQ ID NO: 358 - DNA, 261 bp, dog
catatgcctattgattgtaatatgaagggaagcatatcttatacactgttcataaaaatgtggattgtcatagccatcttttggaaatgtattaaaaattaaaaacagaccctttatctactgttcccactactgggaatatatttaagaaaaatggaagcatctaatggaaataaaaacattagcatgttaaaatatatgtacaaaagtacttattttttacatttttaaggtacccgttcatccccccaaaaaaaaaaa

SEQ ID NO: 359 - DNA, 119 bp, dog
cctgcaactgcgaacaaagatgggatgctccactgataagaaattaaaagggtgaacttttgcactgggtttatgtttattcagtcatgtcaccaaagcaattccatgaaaaaaaaaaa

SEQ ID NO: 360 - DNA, 216 bp, dog
tctctgggattccaggctttcacacgatttggcaaatgcattctccatggctcacgcttaccgatccactcattattcccaaacatgagtgtttcttcctggcatgtatggctcagctcctcctattatctcttcacaaaaggctttcttgccatcattacttaattatcaagtcctacttgtcttttaaggctaacatctaatgaaaaaaaaaaa

SEQ ID NO: 361 - DNA, 148 bp, dog
cgactgtgggagctgccaagtatatcaatcaattaataaccaaagtaaagacatacttagataataatacacttatacttggtgacttcaatctagctctttctatactcgataggtcttctaagcaaaacatctccaaaaaaaaaaa

SEQ ID NO: 362 - DNA, 109 bp, dog
cgtacgtgtaaagtatatagctgccgggtttagtatattcacaaagctgtgcagccgtcaccgcaatcaatcttagaatatctttaccaaccgcctccaaaaaaaaaaa

SEQ ID NO: 363 - DNA, 569 bp, dog
ttttttttttaaaaggatgcaaaatatggcatttgattggtgtttttcttaaatcccttaaaattgctatgttccctcttcctttttttttttttctttttcttcttgcagtttgttgaagaaactggatcgtttgtcctataggccttatcacattatggattgtgttgattgaatttccataggctctctgaacttgctccttgtatttaaaaactagtagttaggattagagactaaatctgattattgtattttattggcttcctgaaaatattgtatactttcctatatattgcatactttgtattatacacttgtatattatatacaatatattgtgtattatatagtctatcacattaggaaccatattagactactatcttttttaaagtttttatttattttagagagtgagagaaagaacaataacagggagaggagcagatggggaaggagagggagagggaaaggggaaagaatctcaaggagattatctgctgagcatggagtggtgagactccatctcactatcctgagatcatgacctgagctaaaaaaaaaaa

SEQ ID NO: 364 - DNA, 203 bp, dog
caagtttccatagaatgtaatgtaaccatgttattctttcaacagatatgcagtaggcacatggacagtactgtgcaaaagatggctaaaaatgcccatatcttcgccccaaaatctttgttttgagggattaattgacataaaaatggtctgtgtcacaactttcttttttaaaatgtctatttatttctgaaaaaaaaaaa

SEQ ID NO: 365 - DNA, 532 bp, dog
acgcaactcaacaccaaaaataaataaataaataatccagtttaaaaatgtgcagaggacgtgaataaacatttttcccagagaggacatacagatggtgaacacatgaaaagatgctcaacgtcactcattatcagacaatttctttatagtaagttattatagagtcagcgttgctggcaatactttgagacctgactcctaagattagggtattttcagaacctcacaacaagaacaaaagtcgatggtgctctctgcaggaagtctaaatgagactctgtgaaatcactgaaataatctactataggtatcactctcatttccagatctttgtgatgatattgatagaagatctggagcacacattaccatactgcaccaatataagccctagtgaacaacaacaaaaaaaaaatggacagagaaaactagaggatccagaactctccctcccccactatctggaagaaaacaagtgaaaacatgctatgatctctagacagcatactctacctgctaaaaaaaaaaa

SEQ ID NO: 366 - DNA, 498 bp, dog
agaggcaaagagtagatgtgggtagaggtaattccatttgggatctgtttaacatgatgtacctggaaagaataggcatctgattactacagccttaaattcgggagagtgcttggggttaaatgtgtagattagggcacatgagattatccagcaaaagaatgtaaagacaaaaagacaaaagaaatgctgaggcatctttgttttagaagtcaagcgatcccaggaaagaacctaagacttattagggctgccttaactttgactggagtgctgagccctgccagacgcaacagaaatgattaaatgatgatgcctgtaatggttccattgtatttggcaaaaatggaggtcacttttgtttagtatcattcggtagagtggatggtgcctgagagcccaatgtcatagggttgaagaatgaattggaagtgagaaaatggaaatagcctgtgcattctactcttcagaaagctcgcatagtagtaaaaaaaaaaa

SEQ ID NO: 367 - DNA, 148 bp, dog
tcctggacactcttgcatcatatataaatttttgaattgtgtgatcaaagttgtgatcaagtcttacatcaagcaatatacaaacgcctctgactagtatggtaaatgagttcttgcatggtttaagaaggagttggaaaaaaaaaaa

SEQ ID NO: 368 - DNA, 288 bp, dog
tgagactagaactcaatcacaagaagaagtctggaaatatttcaaacacgtgaagcttaaggaccatcccgctaaaagatgaaagggtcaaccaggaaattagggaagaattaaaaagattcatggaaactaatgagaatgaagatataaccattcaaaatctttgggataaagaaaaagcagtcatgtgagggaaatacatcgcaatacaagcatccatccaaaaactggaaagaacccaaatacaaaagctaaccttgcacctaaaggagctgagaaaaaaaaaaa

SEQ ID NO: 369 - DNA, 244 bp, dog
cgacgctcactatagtgaaatcatatatgaaaggatagagagccctagaatcttgaagaatcccttaggaagagatagagtccctcttgaatatgcagctgttcagggctctttgaaccgaaccccactagctcactgtgtgacactgagtgcagtccagggatacaggtccattggggaaggggtgttccctgctgtgcagggagatcttccaacatcctcccattttctgcaaaaaaaaaaa

SEQ ID NO: 370 - DNA, 348 bp, dog
cactagcagataattatttgtctttccaccaaagcaatggcaccttgccaatttttgagaaaatatctagaaattaatgttttactgctctttttcataagggtttgtagatctgcgcttttcttgttgttattggcatcgttacataaatagcagtgatattctgtctctattctccagtctgtctcttgttcccataaaataatgtggtattaatttaaaccaagttaaggagaataagttttttatatggtttggttacagatgttagtttacagatgaagcaggaagtgctgatgtagaagctgcagcaagttattcagatgttagtttctggaaaaaaaaaaa

SEQ ID NO: 371 - DNA, 261 bp, dog
gcggtgactttggaaaaatggaaagcaaatgctcaacttaaaccaaggaaaatattgtggatttaatatttgataaaactgattttgtttaacgggaaatgtgtcatttttagtcgtaaaatgtcacttttgctggcttagtcaggcacatttatgcaattaataaatactaaagtaaagttaaaaagatgagcaatagagtagaaatctcttacttagttgactcagaatgcttatatcattatatcataaaaaaaaaaa

SEQ ID NO: 372 - DNA, 247 bp, dog
ctcaacggctaaataattataaacacctgggctggggtggagacaaatttctcttcagctcccttagtttggctccctaagtagatcacttactaaatgctttggatgattgtccgcttctcaataattgaaagttggtggtagctgtattcttaatgatgtagaaggctcaaaaataattacattatgctcctattctatcatctaaaacaaatcattaaaactaatttctacctaaaaaaaaaaa

SEQ ID NO: 373 - DNA, 514 bp, dog
gctgctcagggtgtgtgaacggtgggcatgggtaatctgaaaacaaggctcaacagtgagcttgggcgtcttgtctttaaggggagtctttttccccatatttaatattatgagaagagtaatatgtgcccttgggttgaacacaggaattaggatagtcttagaaaaggggagcagactctttagatgtcaggggctccaaaagggggctgcctccctctttaaccatgttgttggctagactctatccttctcccacttgtcttggtgagtttcaccctcctgacaaaactgtgtgagaagagtcctgtagtttcctgtttccaaagatgaaggcggtggacgaatgttcttcagtgtgatctaggttggctttgtcagctgcaaaatggtaccaacccatcaatttttaaaacagcaggagccaacatggagtgatgcagcggggctcttttgaccttttgatgacgatgatgttgatggtgatgaagaagttgatggtgaaaaaaaaaaa

SEQ ID NO: 374 - DNA, 197 bp, dog
accaggtcttctgcattatttccccacagtaaacaatatactcttttgtcatgtttctttgtcccctaattcttctttcatccatagcatttgttttcccaaaaatagactttaaggtcctatatattaggatcatgtgcacagccagcagtatgctggtaaatgtttaacaactgactctctgggaaaaaaaaaaa

SEQ ID NO: 375 - DNA, 140 bp, dog
cctgcaacacgaggctagaactggaaactgaaacatgagcctgaacccctcaccaccacccctctgcaccctgagaggaatcactgcctgtgacacatgggtgcagtgcacagtcctgaacgttactccaaaaaaaaaaa

SEQ ID NO: 376 - DNA, 299 bp, dog
tagtccacagccaaatataaggattggtgaattgtttaacagttgaatactgtatttcattgatttccttttgtttggcattctgagatctctgaaattgagacattccttccatttactacctgccagcagcagatatgatatacttaatcgttctctgcacgtgtatgggcttggtcatagctgttcctactgtcatgacaggtgagttacaggtaccgttggtaccacatggttagtttacttttcaatttaaaagatcatactataatttaacatttaggtgggaaaaaaaaaaa

SEQ ID NO: 377 - DNA, 289 bp, dog
gcctttaccgggtaggatgtcatctttaaatagaaaaagaatgctaacaaactatacacatagcatatgggctttgctgatttatgtttcaagtttctttacataatatatgcagctttcttatttttatattctaggcattaagtatacatagcagatttttccaattaacgaatacagcaggagctgcatggttcatgttagcctgtaaatcattttaatttgatagtttagattcatgtgagtgaagaaataacaactaaatcagggctgtgtagaaaaaaaaaaa

SEQ ID NO: 378 - DNA, 256 bp, dog
ccacgtaactgggcttccaggctttcgcatttgggcccctatattttctgtaggaaaaatcggtgagaacactttttttatataggtaactttaagaccatcattacgctgtgcgtaaagaatgtacagagaaatttgtaggtattttttgaagaacaattaatttgttaatgatatgtagctatttaatttcccctttcccattgtaatcattcatattttttgtttggaaaaaaaagttgatcaaaaaaaaaaa

SEQ ID NO: 379 - DNA, 271 bp, dog
gtagtaatcagtcaaaaaacattttttcttaaaggtaagttttcttttagaaagtaggtcagataattattctgaaaatatctatataaacacaaaatgggtttacaagaaacacaaagcaattagcagtaaatcacctctgcatccactgtataggacaaaacataccatattatattatgtaactggcactatatcaaaggttttctctatcatctcttttgaggtaaataataggctttttaaaagaaattcaagctaaaaaaaaaaa

SEQ ID NO: 380 - DNA, 372 bp, dog
cagggcatatgcagagagatatctgaaaaaaaaaagtgatggttcaaatttggtacaagatttagacatagtctaaaatactttgtgtaccttcactgcggagaggttctttgacagataaggctagtttctctgcttcctactctccctgggacaaatttgatttggaaccatctgtatgaagatttgtaggaaaaaattctcaaaagcactgtcagcagttaaactccttccttagttccaatgatttgaacctcagttttcctgggaggggcctattaatatagacattaagggtaactttcatatattgaattaaaattggttttttgccccctgttgaaagaattgtggttttcagaaaaaaaaaaa

SEQ ID NO: 381 - DNA, 737 bp, dog
ttattcggaaagatgccttgccactgggaaccttttccaagtatacctggcatatcactaatatcctgcaagttaaacaaatcttagataccccagaggtaagagggtatttctacaatagtaggagggcaaaaaggggaagagagagaagcaagtgcaggaagtctgttcgtaccagttttctgagtccttgagttatagacaccaaagggaattcctttctttcatactaagagattattcagaaatacttactgctgtgtggttctgtgattttaatggcttttccctagtgcttgaaaaagtatcttaaattggagtatcctttttctttgcctttgggatcagaaaacagatcacttttctcatgaattaaataatgaaccccttctagctatggtgagccctagattaactgacagtaagcttaaaagtatataaataatttgagatgatacactattcgtgaagtcggtgaactcagcacaattaaatgcttctccgcaaactgcaacgtagttctcattaaagaaatgacccctaattagtttgcattcttttttgcaagggaaatactagacagttttaaaccttatatttttcaaccggatcctgaaaattggaggtttttcccttcttacaataaaagaatattgtagaaaactcagcatagtgtgatttgatacgttaagatgagcttaagtgcaaggcatttgttactttcagaaaaaaaaaaa

SEQ ID NO: 382 - DNA, 185 bp, dog
agttgctataaaataagtgatttgatcttcagggatcacaatatccaagtggaattaacttaggagggtacaggaaaattcacttaaaaaatgatcattatagaaaacaaggcaatagattgaagaattataactaattccaggaacagtccatgaaagaaaaactagaattggaaaaaaaaaaa

SEQ ID NO: 383 - DNA, 631 bp, dog
tcaaagatctataatatttttcttgtataagaaagaaatgactcattatagtcataatgtgtcacagagactcctgatcaaacaatacatgggctctgttttgtgagttctgtatagcacattgtcaatggacttgcctttgtggatgggaaagtgccacttattccagcaaattacctttgtggtatatgtacctgcttgttagacagcttgtgggcaccccagtgaagcacaggctgagctcctttatcgtggcacacctgtacctcgtgtccccaccgtgctgggcaccagggacgttacccctttcacagacttactctttgagaaacccactgaggaggacctgcgattagtgctggcctgcccagcagagcaggggtgggctggcttcctgtgcttagctcctttacttttccatcagttttggttctctcttaagataccagcgattcaaatcatgaggaaagtaacgtcagtggaatacaactgaggaaataggatttatgaagtactgggcttaatgtttaattgtcgatttcattttcagcactgttgtgaaaaaagaaaagttgcttatcttaggatattagaattggaaggactcgtgtgtccagatgaaaaaaaaaaa

SEQ ID NO: 384 - DNA, 137 bp, dog
ttatccgtaataattgtgggggaaaaaaatattaacatcacatctttgtctctagtacagtttttcgagatattccgtagtacatatttatttttaaacaacaacaaagaaatacagatatatcttaaaaaaaaaaa

SEQ ID NO: 385 - DNA, 315 bp, dog
ttgaggtggaagggggaactctaccctcagaacatgagggaataatatttacgtggctcacacagaccagcaatggatcacttgaatcctttattgccgagtgcgatcggaggactgagcttgccaagaagcggctagcagagacgcaagaggagatcagtgcagaagtttctgcgaaggcagaaaaagtacatgagttgaatgaagaaataggaaaactacttgctaaagctgagcaactgggagctgaaggaaatgtggatgaatcccagaagattcttatggaagtggagaaagtccgtgcaaaaaaaaaaa

SEQ ID NO: 386 - DNA, 207 bp, dog
ttattcgtatacctcagaggacaaaaattcctttctttatgggtattatttataagttaaatgttacttctccacttacattagtaattatttacctgctttggaattcatacattacaaatttgccaaatgaaagttgtcagatgggtgcatatatttgtgctattcctctgttgcccattaggagctggtttggaaaaaaaaaaa

SEQ ID NO: 387 - DNA, 297 bp, dog
ttgatcctagtaagctgtgattctttgtatccataagtctacccaacttctgagctagtggtttcttctgtgacctcagtcttctgatggatctaaatggagttgatttttagtctctttagcttttttcttgttgtgagaacggtagtgatgatttctaagctctttaattgttggaccagaaaccacaagtcaatagcttcctcttagctatatgtcctagtgccaatatatttatataaaacaactggtattgggcctggtgcacaataaggagtccattttgaaaaaaaaaaa

SEQ ID NO: 388 - DNA, 146 bp, dog
acgatgccaggtgcaatctactggaaatgtagcacttcgcgtgaaatatttgttttcccccctgttttaatatgaaccgatcaggagtaccaaataaatctcccaattaaagattattgtgacttcactgtatataaaaaaaaaaa

SEQ ID NO: 389 - DNA, 333 bp, dog
ttaccgccaaacctaaagcctgcacctccacccacaatagaagagaaagttgctaaaaaatcaggaggagctactatagaagaactaactgagaaatgcaaacagatcgcacagagtaaagaagatgatgatgtaatagtgaataagcctcatgtttcggatgaagaggaagaagaacctcctttttatcatcatccctttaaactcagtgaacccaaacccatttttttcaatctgaatattgctgcagcaaagccaactccaccaaaaagccaggtaacattaacaaaagaatttcctgtgtcatctggatctcaacatcaaaaaaaaaaa

SEQ ID NO: 390 - DNA, 428 bp, dog
ttgaggtgagaactttgcaaatccctaacctctagtagaaaagtttcaaaaacactgcagtctagcagttcacttgagcaaataagtacatacagtcttcatcctaacatttggtaccatatggcactccgatgtccacacaaagaacattccaccatcttctacatcactcagtggccaactgtcaagagcaaagatgttcccacgagtagagagagaggatttgttacaatcacagtgggtccaggcacttgttttcctaaccggtcagcttgacgcctgcaccattggctcattaaaaccagatcctttgacagatagtggcattattatttcccgagcatgaacacactgatgtatcaaaaatgctagtttgcttatttgttacaggaccataccatcgaaatttaggaatagaaaaaaaaaaa

SEQ ID NO: 391 - DNA, 354 bp, dog
ccacgtaaagtaaaaacacgtgtgttcatttcaagcctctgaagaccaaaaatttaaaagatcccctaataacttagatttcttagatggtggggttttcttttccctgttcttaatcctatgccttggagagactgctcacaggaaaagagcgcttgactgtttgaaatcctgtttgaaacctatttaagtctctgcctaatgtatcagagcagctggctttgggataataaaaagctgaagaacagccccatgttcgctttgtcaccgaaacatgactgtctctccatttctttttgcatgaagcacaagcacttgcagagtatttgttagatctgtagctaaaaaaaaaaa

SEQ ID NO: 392 - DNA, 212 bp, dog
tcctggatgatggaggagcacaaacattatctgaaagactggaagagttctagactgggagagtttaaattattctgtaagctatatgattattcataatctctagggatgctgcacacagaaattttgtcgtatagataattgtggtttcagatgactgaattttttcttaagtttatatattattatcctctgactctgaaaaaaaaaaa

SEQ ID NO: 393 - DNA, 185 bp, dog
catatgcacaacaagcagtgccatggacttactagtaaataatgtgttacatatatacaccatttcaaaatgtatgtagatggtgttaatgattagtgaaatacaaatccaataaagcgctgtttaatttgtagtaaccttatgccactgtatattttctcaaatagtggatttaaaaaaaaaaa

SEQ ID NO: 394 - DNA, 139 bp, dog
ttatccgtaataattgtgggggaaaaagatattaacatcacatctttgtctctagtacagtttttcgagatattccgtagtacatatttatttttaaacaacaacaaagaaatacagatatatcttagaaaaaaaaaaa

SEQ ID NO: 395 - DNA, 163 bp, dog
ttaccgccagggatagactagttagagaagtccatgaacatgctaacctgcgtctcccaacacccacgtagtccgtgggagaccctccagccgagaaaacacgtctcgaaactgtgatcacaaattaatcaaacacacatgtaaatcctgtgaaaaaaaaaaa

SEQ ID NO: 396 - DNA, 137 bp, dog
ttatccgtaataattgtgggggaaaaagatattaacatcacatctttgtctctagtacagtttttcgagatattccgtagtacatatttatttttaaacaacaacaaagaaatacagatatatcttaaaaaaaaaaa

SEQ ID NO: 397 - DNA, 141 bp, dog
ggagcttgctgcaggagcaaaatcagcaaaggctgaaagtgagagaagatggagtttaatgcacaaacaaaaagaatatacagggtttaaaacaaagacacttggtatccagtagacagctccctaatccaaaaaaaaaaa

SEQ ID NO: 398 - DNA, 388 bp, dog
cggcataacaatgacagactctcagaaggagacaataagtactctcaaaccagtcacaaactagtgcagcttttgacaacaactgcagagcagcagttacggcatgctgatatagacacaagttgcaaagaagtactgtcatgctcaggcacttccaactctgcctctgctaactcttcaagcggttcttgcccctcctctcatagctcgctgacggagcggcacaaaattttgcaccggctcctacaggagggtagcccctcggatatcaccactttgtctgttgagcctgataaaaaggacggtgcatctacttctgtatcagtgactggacaggtacaagggaactcgagtgtaaaactagaactggatgcttcaaaaaaaaaaa

SEQ ID NO: 399 - DNA, 462 bp, dog
cggcatacagggcagatgtcagagattatgatcacagggtgctgctaagattccctcaaagagtgaaaaaccaagggacatcagatttcttacccagccgaccaagatattcctgggaatggcacagttgtcaccagtaagtggatgggcctcctaggtccttctgagtcgtgttttcctttttttcacagagttcttgatgtgacaagtgcaaagtcttatttcttacagaaaagggagaaaattactgttatgattacattcagaattttctctgtgtaatgtgacatcatcaaggaaacatatcagctacaggatcctgttatcttttaaaatggaaattcaaatccagctcgttaaaattctaagttcagctcattaaaactgctgatagggatacagcattggcttccctaatattttattccaatgaattataggtaagatttccaaaaaaaaaaa

SEQ ID NO: 400 - DNA, 536 bp, dog
cggcataaggcagaggcagataagaacgacaaggctgtcaaggacctggtggtgctactgtttgaaacagctctactctcctccggcttctcactggaggatccccagactcactccaaccgcatttaccgcatgataaagctaggcctgggcatcgatgaagatgaagtggcagcggaggaacccagtgctgctgttcctgatgagatccctccacttgagggtgatgaggatgcctctcgcatggaagaagtcgattaatttctccttgcagatcttgtgccctctgtatagtgtccccatggctccccagcagccctgagtggccccggttcacctggttccctctgctgatgtctagtggatttttttttttctcttcctgtctttgttagaggcaggacagaagggccttaagccctagccctcatgacatttgacaaggggtttggatgtgtattgtggtgtttgtttattttgttctgagattaaagtatgcaaaataaagaagatacggttttatacaaaaaaaaaaa

SEQ ID NO: 401 - DNA, 175 bp, dog
gagtgctgtgtaggtctgatggaaacccttcagcttcctgtctgaattgggactgaaaggctggcaatcagaattgaagagacctgattttctgggcagaaatgtatgggtttttaaatgccctgtccgcctctacagatctgcttatgtcatccacaacttgcaaaaaaaaaaa

SEQ ID NO: 402 - DNA, 177 bp, dog
gagtgctgatagtgttggtggagttttgtttccatttggcttgggatgaggaaattgttctttttcctcaaggtctgactttgtgcagagcttttgtgctttatgggtgcccagtgtgtgttggcaaaggaaataaaaaactagcagtgccataaagtaaggaaccaaaaaaaaaaa

SEQ ID NO: 403 - DNA, 244 bp, dog; identical to SEQ ID NO: 225

SEQ ID NO: 404 - DNA, 397 bp, dog
gagtgctggggtcaggatgggagggagccaagagtttactgggagttcccaaagatgaggtgaaggtgggagagagctttgcagatcaagagggtgagcagccattatagcaatggggatctgaatggcagcaccaagaaggatggtgaggactggtttagtgcctggtggggcatggatgagagggagggaaagagcctttgccctagggtgaccagactatgcttctcagaagaccaggcagtgaagagaatcaagaaagtaagacacagttgtaaacatgttacagaaaagaataaagttaatagtaaaatcatacttttcatccctgtttctactccaccaacagcctgtgcttggccttgcctcctttttaagattctaccaaaaaaaaaaa

SEQ ID NO: 405 - DNA, 232 bp, dog
gattgcctacagaaggctcctgtcaatacactgctttcaaatttgatactaagttttctcacagattgcattaattttgtatatctcaaacaggtcaaattttttgtgtatctccaggtcaaatttttattgttaacaagagactaaagatgacattttttgccttgcatttttcctaggatatggcaaaaatgtgacttcattttagttatgtgcaccaccaaaaaaaaaa

SEQ ID NO: 406 - DNA, 133 bp, dog
cgggtaacctctgatgtgtagtcataactcattttgctgtgctgcactttatcgtgctttgcagatactgtgttttgttttgttttgtttttaataaattgaaggtttgtagcaaccctgccaaaaaaaaaaa

SEQ ID NO: 407 - DNA, 181 bp, dog
cgggtaagggactggcagaaagggtcccacgaactggcgcgagcaggggcccgcttaccaagatgagctgcacataccccccaagggaggaccacttcctttttcttggctgccgctttctgaaaggagtgagctatcatcagtgctgtgaaataaaagtctggtgtgccaaaaaaaaaaa

SEQ ID NO: 408 - DNA, 228 bp, dog
cgggtaagatcagagccctggaaagaggcagtagcaggaggagtcagggatatacatcaattgaacatcaatcgtgtgtcctgatttgggagtgattgagggaggaggtgggttgctaatctcatggcctgattttttttttttttctattgatatcactgttagaatcgaggggtaggggtggtgaccggaaataaagtcctcggatcttccgccccaaaaaaaaaa

SEQ ID NO: 409 - DNA, 235 bp, dog
gattgccgatgtggaaatttgttttgtggacttcaccgttattctgacaagcacaactgtccatatgattacaaagcagaagctgcagcaaaaatcagaaaagagaatccagttgttgtggctgaaaaaatccagagaatataaattactacttgtgaagagactgaaactttgtttttattttaatatatcgtaggaaaacattaaagagcagatgcatggccaaaaaaaaaaa

SEQ ID NO: 410 - DNA, 144 bp, dog
ccacgtaggggggcaggctttaacaaatatgacaatagaatatggcatttccagttgtcctctattgttaggggcaacttctaaatgaccctaaaaatactgcatttagtaattttgaaaattatgagtttctccaaaaaaaaa

SEQ ID NO: 411 - DNA, 164 bp, dog
ccacgtacggtaccccctccacacatggtctagtctgatttacctgcttcctgggtacaaacttttgactgtctctgagtaacagtatttattgaaggaaagtctactgctattacctgttgtgataaataaagccactcgtgtgaaagcctcaaaaaaaaaaa

SEQ ID NO: 412 - DNA, 176 bp, dog
ccacgtagctagatgataataagtagagaaaaaggcagtaaactacatatgtcaatataaaataattgggttctatttgctataactgaaaacatttcatttaaaattactaagtctgggagctaggcacttttcaaataagctaaatgtctatcactgatgtacaaaaaaaaaaa

SEQ ID NO: 413 - DNA, 251 bp, dog
ccacgtatcgtgtgtgtgtgtgtgtgcactcctcttcctctccatacgttcatttggatgccgctgggtggggagtttaggcacccagggaggggaggaggcaaacatgatgtgatgcagatgtttccccaacaaaccctcctttctggggattaataccagccatttttctgagagagttttggagtccctcgaagttatttatttattattattattattatttgaataccccatcccaaaaaaaaaaa

SEQ ID NO: 414 - DNA, 344 bp, dog
ccacgtagtcaacccaagcccatgaccgctgacaggagccctttctgccctccttataacatcgggtcttatcatatgatttcactataactcgatatccctacttacattaggattcacaaccaacctgttaaccatataccagtgatgacgagatgtgatccgagaaggcacattccaaggacatcatacccctattgtacaaaaagggctacgatacggaatagttctttttatcgtatcagaagtatttttctttgcaggcttcttctgagccttttaccactccagcctagcccctactcctgaacttgggggttgctggcctcctaccaaaaaaaaaa

SEQ ID NO: 415 - DNA, 403 bp, dog
ccacgtagggcacggggtaggctcttccctagtactttgtctttaaatcagttgactataaacaatcatttgaagctctcattctttgaagctagtattccttttcattctaatgcccctaggaatgtctcctgaacagtagcagctgtaacttataaatgggcgatctgtgacatgaaatgttaggtttatctgcatgagaagtagaagagtgttctttcctttctcggcaacatataggaaagtagaaaatgagccttgctctccacaggcagctttgcaatagaaataagcctgtttcaaatgagatgcttcccaagttaagatgcaacaaaccagagaagcaaccttttgatttttaactaataaactgtcagcacatgtatttccccaaaaaaaaaaa

SEQ ID NO: 416 - DNA, 240 bp, dog
aacgaggaaattgcagagacgtatccaggtgtgtggccgagaggaagtacacgcaggagcaggcccggaaggagctacagcaggtgttcatcccagaatgcaacgacgacggcacctacagccaggtgcagtgtcacagctacaccggatactgttggtgcgtcacacccaacgggaggccagtcagcggcacagccgtggcccacaagacgccccggtgccctggttccaaaaaaaaaa

SEQ ID NO: 417 - DNA, 218 bp, dog
cattccgatgcatagtattgatctacttctgtaattgtgcggattctttaaacgctctaggtacgatgatagcgttccccgataccatgctgtgaggatccggaaggaagagcgggagatcaaagatgaaaaatacaatgataaccttgaaaaaaaacagtggatcacaagttggaatgaaaatgaaagctactcttaaaaggggccaaaaaaaaaaa

SEQ ID NO: 418 - DNA, 289 bp, dog
cattccgactcaccacgtgcctcagtgctatctcattgcccagccctcatgcataccgcatgtgttttctgtttatttgtgctagctaccctacttcctgaacacctggctcagcagcaccctcctccataccgtatgacacctgctgacctcttcttgtggcagtgacctcatgcttttgtaatgttttagttgtttccgcttgacactctgagctacttgaggtccagaacattgccttactttttcctctagtgccagtgcagagtggatggttcaaaaaaaaaaa

SEQ ID NO: 419 - DNA, 196 bp, dog
ttaccgcatgatacaagagtctgctggtgaaagagagaggaccggaaagagcatttgctgaagaggaggagggagaaaaaaaaaagaaagaaagaaagaaaagaaaaaaagaaaaaagaaaaaagaaaaagagaaaagaaagaaaaggaaggaaggaaggaaggaggaggaaaaaaaaaacccacaaaaaaaaaaa

SEQ ID NO: 420 - DNA, 373 bp, dog
aacgaggtagtgaccagagaatacaccatcaacattcacaaacgtatccatggagtgggtttcaagaagcgtgcccctcgggcactcaaagagatccggaaatttgccatgaaggagatgggaactccagatgtgcgcattgacaccaggctcaacaaagctgtctgggccaaaggaataaggaatgttccataccgtatccgtgtgcggttgtccagaaagcttaacgaggatgaagattcaccaaacaagctctacacgctggttacctacgtacctgtcaccactttcaaaaatctacagactgttaatgtggatgagaactaatcgctgattgtcaaataaaggtataaaactgctccaaaaaaaaaaa

SEQ ID NO: 421 - DNA, 159 bp, dog
gattgccagggctgggcggtcagggaaatagaaagaggttggtaaaagtgtataaactttcagttataagatgaatgaggtctgagggtctaatgcaaaacatgatgactgtagttgatagtactgtatcgtataattgaaatttgccaaaaaaaaaaa

SEQ ID NO: 422 - DNA, 199 bp, dog
gattgcccattagttgcttttcccccccattaattgttttttgctaaaactataaatcccagcaacaaactggtgtgtaaaaataatttaagatttctttacagagatgtattccccatttttgtgggaaaaaagccaagtttactttgcatttgatttttttaaatattaataaatgagttgtatgcaaaaaaaaaaa

SEQ ID NO: 423 - DNA, 232 bp, dog
agtaggcatggctatggcctgttgtgtatattagggccagaaatgtaccataaatcttgttatttttctggataatgtttaagaaatttacttttaatcttgttctgttagtatgaaaagttaacttttttctcaaaataaaagagtaaatttttcatgttaagttaaaaatctttgtcttgtaatatttaaaaaaataaagacagcaatgacttatatccaaaaaaaaaaa

SEQ ID NO: 424 - DNA, 257 bp, dog
agtaggcaggggaagagggaaacaagcagactccctgctgagcacggagcccaacttggggctcagtcccgggaccctgagatcacgacctgagttgaaatcaagagtgatgcttaactgattgaaccacccaggcccctgagggtagatatttcttatcttgacctgtgttccagtcttgaattttttcttgtacttcctcttattgcttccaaatatttctctcttctctctaccttcccttacaaaaaaaaaaa

SEQ ID NO: 425 - DNA, 220 bp, dog
ctcaacgacaaacatgacatctcaaaggtcaccagaatcctgtttatattcatagaacggcttccttagtatccaaccacagagctaatttactctaatgtgagaaaaattctaacaagcttgttaatatggtttatcggtcttgggaataataaaagtaacaagggaagcatacagatggatttggaggtggtctcagtgactgtggcaaaaaaaaaaa

SEQ ID NO: 426 - DNA, 271 bp, dog
gattgccatctataacatggattacaagagtctttaagccagtatgactattaccccttgagaataaactatataatataaatgcaatattggcaaactaaatcagatgctggtattagcctacagatggccagctgtacttcctaagatttagaaatgattaaaacatttttcatcttctatagcacctgtttttgagtgttcctgggaaacataaaacttagttttattttcctgaaatgcaagagtatttcattggcaaaaaaaaaaa

SEQ ID NO: 427 - DNA, 176 bp, dog
tggtcagtaagattaagagaatgatctgatcatttaatgattgattgtatgaccctgtacttgtcagttagcccttaggaagtttgaagtagaaagtctgaagttcttttcagatctaaaaatgctaagtacttacagttttaaaactgatacccccctcccccccaaaaaaaaaa

SEQ ID NO: 428 - DNA, 192 bp, dog
tggtcaggacctgctctatttcagggaagaagatttatgtattatatgtggctatatttcctaaagcacctgtgtttttctctttctaagccagggtcctgtctggatgacttacggggaggggggggagtgtaaaccagaacttttaatctatttgaaggtgattaaactgtgtctaatgcaaaaaaaaaa

SEQ ID NO: 429 - DNA, 268 bp, dog
tggtcagaagaagagttgggtaccttttttttttttttttttttttttgtgattaaggcctaagcgtgagaaatcttacttgctgggctaaataatgttgttgtcactagctaaaagataaataacttggagaaaagtcttgagagattgggaagaagggagagaacggcagggtggcagcaatggtaaaaatccctaatgttttaatttacagcccaaacttctgatatataagtttgtatgtattgactcagatgcaaaaaaaaaa

SEQ ID NO: 430 - DNA, 184 bp, dog
tggtcagatgagggcactttttctttacatttctggagtttgagctgtgaagcagatttgtttttccccatccaagctgttacttgctttctgttgttattgccagtgagagaaatagttttgacatttttaatgttttgattgtgtttattcttatagattgatctttccccaaaaaaaaaaa

SEQ ID NO: 431 - DNA, 444 bp, dog
tggtcaggtgcaggctgctctttccttagcaaaacctggagcagtttcggtaggttaaatggcttgattaaatcttgagctctgagttggaaagagatgagaagttaaccccttgagccatgtggtctcttcaggatcaagaggctgtacatgtgtgaaaaatacggactaagaacctgtgttcatagacaatccgaactgtgtttctgaagtttgtgcacattttccttcactgtaatattattttacagctgtttgttaaaatagtgaataatttaatggttttaaaagtaacaggttttgtgtgtgtacttgtatatgtgagaattgccttattttcagattgttttatttaatgatggttccttagacagcgttctaatgttcagcaaccatggaatatttgtcattaaatccatatcagtctttttccaaaaaaaaaaa

SEQ ID NO: 432 - DNA, 228 bp, dog
cgactgtacacccatttaaaaaatgcatggtttcacggtgaaaccctatctctactaaaaatacaaaaattagctgggcatgttggcatatgcctgtgatcccagctacttgggaggctgaggcacgagaatcgtttgaatctgggaagcagagactgcagtgagctgagacagggccactgcactccatcctgagcaaaagtgaaactctttctccaaaaaaaaaaa

SEQ ID NO: 433 - DNA, 542 bp, dog
cgactgttagatgaaagaattatccagaagagcaatgtgtaagtatatgaaaggtatcaagcatctaagaataataataaaataggtgtaagagttttttgagattatttatcaaactttagtagatattagagaagacttacatagacatcgtgtcaatgtgttgtaagatccattgatttgatgtcagttccctgcaaacacattttctagattgaatgtgatcacaataaaaatcctaatttttttgggggggggaacctcacaagttagttctaacacttatataaaaaaatgaaaggtcaaaaataaatgatttcatcttaaagaagaacaaggtaggaaaagctgttcttccagacatcacaatttattataaagttatactgagttaaagcagtagggaatttgtgtagggacagataaagcatcagaagaaagagataccaatccacacccatatcactgtaagaagaaaaacaaatttaattggaataagataagaatggaaacattctgctgttagactacaaaaaaaaaaa

SEQ ID NO: 434 - DNA, 200 bp, dog
gattgcctgatgttgttcatgatagaaagaataaaatgtttctctctctctctaccttttaaaatggaatagtttatttccgtggaaaatacttaaaactttcaatattttaattttttttctttacctttagaaaaggccaatatacctgtcacactttgggagtaagaaatacatacttacgtgtacaaaaaaaaaaa

SEQ ID NO: 435 - DNA, 199 bp, dog
gattgcccattagttgcttttcccccccattaattgttttttgctaaaactataaatcccagcaacagactggtgtgtaaaaataatttaagatttctttacagagatgtattccccatttttgtgggaaaaaagccaagtttactttgcatttgatttttttaaatattaataaatgagttgtatgcaaaaaaaaaaa

SEQ ID NO: 436 - DNA, 638 bp, dog
gattgccactgctaccacctgcattcagattcttctgtctctccttgctcagtagtgtcttgactcatggctctgactcatggccctgactccatctccttagctcaggtttgcccactggtttgagaattacaggtgcacacccttaactatgccattcttctgcttttatgcatctcatggtcctacactgccttaagaaacacacttcattagggacccctgggtggcgcagcagtttagcgcctgcctttagcccagggcgcaatcctggagacccgtgatcgaatcccacgtcgagctcccggtgcatggagcctgcttgtgtctctgcctctctctctctctctctctgtgactatcataaataaataaatttaaaaaaaaaaagaaacacacttcatatcatgaccaacgagtcatcttcacagcttagtcccagtcactgtagcctgttttattcaccttattgacttcctctaattctacctaatttaatgtactgaacctcatgcttctcaagctgccaccatcttttatactttgcaggtagaatactactgactttcccccttcttccaggaaatctgttttccctttccctacttgaaaaaaattctactcacccaaaaaaaaaa

SEQ ID NO: 437 - DNA, 138 bp, dog
ggagcttgagaatatgactggaaacttctaaaactgaaaagtaaatagaaaaagtacagggaaaaaaacaatatccaagaattgtgggacaattacaaaatatgtgatatacacatgatgggaatccaaaaaaaaaaa

SEQ ID NO: 438 - DNA, 194 bp, dog
acgcaaccgcatgtaaaaaagcaaaaaagttatttgtgtctgtttatattgcttccttttttgtagcctttgtacctgtacagggtgactgtaagggccaagcaggagaggcgtaatccttgtataaaataggagccagcgacactcttgtatttatctgttctctttttagtcagtcacttcaaaaaaaaaaa

SEQ ID NO: 439 - DNA, 157 bp, dog
acgcaacaccatacgttaggattttggtcttggtgtttgtatgaaattctgaggccttgatttaaacttttccttgtatcgtgatttccttttaggtgtattgcgctaagtgaaacttgtcaaataaatcttcttttaaaaactgcaaaaaaaaaaa

SEQ ID NO: 440 - DNA, 394 bp, dog
tagagcgtgaatcagtcactactggaactgcacaaactggccactgataaaaatgacccccacttgtgtgacttcattgagactcattacctgaacgagcaggtgaaatccatcaaagaattgggtgaccatgtaaccaacctgcgcaagatgggggctcccgaatctggcatggcagagtatctctttgacaagcacaccctgggaaacagtgatagtgagagctaagccttaggctgtcttcccatagccgcagggtgacttccctggtcaccgaggcagtgcatgcatgttggggttacctttaccttttctataagttgtaccgaaacatctacttctttcgtttgtatcattccttcaaataaagtaatttggtacccaaaaaaaaaaa

SEQ ID NO: 441 - DNA, 231 bp, dog
ggagcttgggggagcagggtaatgaacttgttttctttagtgaaggaggaatacaatcgagcgttttgtattcagaatgttgtgcaatattttggaatgggacattggtgtgtttagagatttagtttaaaaacaaaacaaaaagattgatcaaatctgtacagtttatattgttccagatttttttaagtttgtattaaaagcatgatatataatagccaaaaaaaaaaa

SEQ ID NO: 442 - DNA, 446 bp, dog
accaggtgaaatggaaacagatgagccagatgatgaatccagccaggatcaagaacttccctccgaaaatgaaaacagtcagtctgaggattcagttggaggagataatgattctgaaaatggattatgtactgaggaaacttgcaaaggtcaactcacgggacacaaaaaaagattgtttacattccagttcaacaatttaggcaatactgatattaactacatcaaagatgataccaggcatataagatttgatgagaggcagcttaggctagatgaaagatcatttcttgctttggattgggatcctgatttgaaaaaaagatattttgatgaaaatgccgcagaggattttgaaaaacatgaaagtgtggaatataaacctcctaaaaaaccctttgtgaaattaaaagattgcattgaactttttacaacaaaaaaaaaaa

SEQ ID NO: 443 - DNA, 396 bp, dog
accaggtcaccaagtgttgacatttcccaacttcgaaaatacctccagttcctgtgatcactccaacactctggttagatatgttttgcacaggttccacgcctagaaccttaaaatatggtgcagaatgttttgttccgcatcagttaccaggaggcaagtctcttttaaatggtccggtcagtgattgcggagtgccgtgtgtcagtatggattgaaggcatactttaagacagatcgcttttagatcattttcttaaatataaatatcccaacaattcaaattttgttttttctgtagtttcatgatctataacaccttacaaaaaagtatgaaagtggaagttcttcaaacgaaaatagtaaccaccacctgggttaatctcaaaaaaaaaa

SEQ ID NO: 444 - DNA, 317 bp, dog
accaggtagatatttactttaaaatctgtaaatggaggaaaaggggaatcaaggaatcttaagaagcccagagctgcttacatttctgcaacctgaaagtctgagcaagctctgaatccaagaaggtggataaagtgtgtgcctcctttggaggcattgacgttctaattagacatttcattaattcaaagtttggattgcctgcccccagaattatcttcctaaagatatgtacgaagtagtcctacaaaatattctttgctttggacaacacgtataacaggatttatttaaattgatttggccaaaaaaaaaaa

SEQ ID NO: 445 - DNA, 306 bp, dog
accaggtaatggagagttgggccttccaggtctcttgaagactaaatctgcagtgccaggcccagctgatgggtgagaaggatggcactttcatctgattgcaccactttgagtgaccagcaggagacgatgtcgtcctgccctgtatttatttgccctgtgtacagttatttataactctgtatttaaaacaaaacaaaacaaaaacccagtcttctcttaagggccacttgggccctccctgtatgactccttgatggagatatttatatgaaatgcattttattttaaccacaaaaaaaaaaa

SEQ ID NO: 446 - DNA, 282 bp, dog
accaggtccaaggtgggtgtttttcctgaagtgaatataacctgggactcccccttccccccagtagggagcacaaggaaggggaagttctccctggcagctgagctaggggtggcaattcctggatggagctggcggagaaaagtaacaatgctactatacaacacacaggggacaatcaggtccattttcttccagatgaacaagaaaatctcagggtggcctctgttccctgaaggagggcaactaatcctcatcttggcaggtgctcaaaaaaaaaaa

SEQ ID NO: 447 - DNA, 194 bp, dog
accaggtacctaaggaagaataggggacatgaagggcaaggaaaagaaatgtcatgcttccaagcataaagtaactgagatatgctgaaactactaacagaaatggggaacctaagaaatggatagaggggaagtggaggcaacagattatatatcacaagttgttgcagaaacctgatggtcaaaaaaaaaaa

SEQ ID NO: 448 - DNA, 232 bp, dog
agaggcacaggtctctgattaagtaggtgtataatattgcatttaagtggacatgaatgagctttcctttaccatggaataaatcttcaagctttaagaaacagctttcattcccattcattttccatactggcctttgatgatatgcagatccctggtagcatgccttacctgcagcactatgtgcatttgctgtcacaataaagtatattttgtcttgcaaaaaaaaaaa

SEQ ID NO: 449 - DNA, 178 bp, dog
agaggcagaaacacaggcagagggagaagcaggctccatgagggagccctacgtgggacttgatcccaggtctccaggatcacaccctgggccaaaggcggtgctaaaccgctgagccacccgggttgcacaagaaattttctttaaattgtgatgaaaaaatatccaaaaaaaaaaa

SEQ ID NO: 450 - DNA, 135 bp, dog
agaggcaacgatgtacaacaaaggaaatgaaaaattcaaaagtcattcaaccacctgattaaaagaaaaaccaatatttaatacctactgagtacaaacctgaggagaaccaatctgtattaccaaaaaaaaaaa

SEQ ID NO: 451 - DNA, 285 bp, dog
atcgctccatcctacctggaagcaaaagttttatgcagtattttttaattgaacattttagagcttattggattgcataactataaattctttattattatcgtaattaaaattttgatctctcaaaatgtaattccatgatgttgtatatatgtgcatactgtcatgagtgtgcatatgtattgtgtgtgcgtgtgtggatatggatctgtaaatgttgacatttttagttctgttaacactggtacataaagttaattccttggtcaactacaaaaaaaaaaa

SEQ ID NO: 452 - DNA, 200 bp, dog
atcgctccactgaaacacaacataatgttaattcaggatatcagggactatattctagtgagacacctgatagtcatgtgtttttggaactttagtaacccatcacattctgaatttctgttatctttgaaatgtcatttttaacgctcatattttttcttaaattacattaaaaaatttgtgcagatcaaaaaaaaaaa

SEQ ID NO: 453 - DNA, 161 bp, dog
atcgctcatcagaaagatagtatttggttataagctaaattccatctggcatctgatagttcacttcaaaattccccaaacttcagaaattattttgggcttttgagatcatgaaataggtttctatttttaccaaaatgtttccgccacaaaaaaaaaaa

SEQ ID NO: 454 - DNA, 468 bp, dog
tctctggggagagaaaaaaaaaaaacagtggctggaactgtctccttgtctgccaagttactgaagttctctgaggagtgttaatagttatattcctgatagggttactgccgagggttgacatagcatggatgggaatagtgtctggcagcaggaaataaaagcgattatttcccagctggatccttcttccctgtgtatctgtttctgtgtccctgactcctctaacctttctccccctgccaggatgagccccaagaggccaaaaaggcaccaccggaagacacagagacagatgaactttgggcctccttggaggcagctgccaagcggacgctccctgattcggagcagacccaaggggctctccaaaccagacggagaaaaaagcagcggcctgggtccaccagcgcctgaagagcctatgctcactttgtaaataaacagctcaacacccaaaaaaaaaaa

SEQ ID NO: 455 - DNA, 237 bp, dog
tctctggccgccagaagatccacatctccaagaagtggggctttactaagtttaatgcggacgaatttgaagatatggtggccgaaaagcggctcatcccagatggctgtggggtcaaatacatccctaatcgtggccccttggacaaatggagggctctccactcatgagaaccttgcaccacccgaaccctattcatgcccaccaataaatcctgcttcctgtcaaaaaaaaaaa

SEQ ID NO: 456 - DNA, 158 bp, dog
tctctggatcacaaagtctctgctagaaccctggtttagatgacaacaatactggcagaactgacacttcctcctctctttttctaaattctatgttggaagccccatacagcactataggtaaagtcatttgttttttccccaaccaaaaaaaaaaa

SEQ ID NO: 457 - DNA, 153 bp, dog
tctctggtggatgcaatgatgtttctgaaactgctatgtacaacctaccctgtgtataacatttcgtacaatattattgttttacttttcagcaaatatgaaaaatgtgttttatttcatgggagtaaaatatactacatacaaaaaaaaaaa

SEQ ID NO: 458 - DNA, 532 bp, dog
ggctatgatgttgcctttaactacaaaaccataaagtctttggaagaaactttgaaaaaagcctctcctgatggttatgattgttactttgataatgtaggtggagagttttcaaacattgttattccccagatgaagaaatttggaagaattgctatttgtggggccatctcgacatataatagtactcgcccacttcccccaggcccacccccggagaatattatctatcagcagctccgcatggaagggttcatcgttaatcgctggcaaggagatgtccgccagaaggctctgaaagacttgctgacatgggtcatagagggtaaaatccagtaccacgaatacatcattgaaggatttgaaaacatgccggctgcatttatgggaatgctgaaaggagataatttgggaaaaacaatagtgaaagcatgaaaaaaatgacacatggaatctagaaatcatttggatgatgacttaatttctttttaaccatttaataaaaaatgtatactaccttcaaaaaaaaaaa

SEQ ID NO: 459 - DNA, 173 bp, dog
ggctatgctatgaaaggggacttctttctggtttcaaaaaatatttgctatggcagtaaaaacaaatatgtatttagatgattgttgggaataattttgagaatgttattttaattcactatctgaggttgtgagctaaattataaataatgcaatataatcaaaaaaaaaaa

SEQ ID NO: 460 - DNA, 315 bp, dog
gccatggtttatggatacaatgctgcctacaatcgctatttccggcatcgccgaggaggcaaatgagattgaaaaaagtctctttccttccagagcctggtgcctggttttgtattcctttacagtagcatcatcgaactacataaacacatacaaattgcttatttcttaaatgttcttgtctggctgttgccctccttcctgccccccagatcaataagcagtgaaaatgcaatgtggtgaaaggtcaaaagagaattaagatgtgtgattattattacataataaactcttggatggatacaaaaaaaaaaa

SEQ ID NO: 461 - DNA, 299 bp, dog
gccatggcgccctcaagcccgcgtcccctgagccccgagaacaaaggtgctatcctgcagacccccccgtctactcggaagcctgggccctgggccttcagtggcacaaagcgaggtgttgctttttaaacaaaaaaacaaaacaaaacaacccaaagctcttcttccttaggagagtgattggttctacgtcttactgaaaaccctctttatgtgttagttttctgattccttgtgtttgctcactgtgtccacgtcagccacttttcagaataaaggtgttcattcctcaaaaaaaa

SEQ ID NO: 462 - DNA, 269 bp, dog
gccatggagcggaggactcgaaggctgaccaggctgccaacgaatggggccggagtggcaaagaccccaaccacttccgacctgctggcctgcctgacaagtactgagcttcatttcagttctgtcctcaagagccggtctatgagccccctaacgggaagaacacttattgagttagagttgctgaattctgtattctttctactcaatagtttagaaggagcacataaaaatgtttaataaatgcttgcaaaattcaaaaaaaaaaa

SEQ ID NO: 463 - DNA, 168 bp, dog
gccatggagtaaacagataactgcacagctctggagctgcagtgcctggtgtgaaacctgcctccaccattcacttgtgagtgaggcaaattattaatctctccaagcctcaatttcctcctctgtgaaaggacaataaaatgttcaactcatgttcaaaaaaaaaaa

SEQ ID NO: 464 - DNA, 162 bp, dog
gccatggagtaaacagataactgcacagctctggagctgcagtgcctggtgtgaaacctgcctccaccattcacttgtgagtgaggcaaattattaatctctccaagcctcaatttcctcctctgtgaaaggacaataaaatgttcaactcaaaaaaaaaaa

SEQ ID NO: 465 - DNA, 150 bp, dog
gccatggacattttatgtcttgcttgtagggcataatgccttgtttaatgttcattatgcaatgttcttctgttttggaacagagaagttaaaactactgttatgtttttacaaatgatatgacaataaacgttttacaaaaaaaaaaaa

SEQ ID NO: 466 - DNA, 222 bp, dog
ctgctgggggtagggggaagggtcacctgaaggctgaaggattcacttctatgatatacccacatggctagcaaactggttctggctattagctgggagctttgggtggaagagtggagtaaccagaagtctggagtagagagcccgattccacttcatattagtctctctatggctgcctggattctatgcagcctagtcactgagttccaaaaaaaaaaa

SEQ ID NO: 467 - DNA, 262 bp, dog
cgtacgtccttatcctctgttacttttttttttcttctttgcaatgtgtcttcacaggccacttgtctagggttgctttcacgagagcccatgttaacctcaaagctgtagtttcattgacaacaaaaacagctttatgccatgcatctctttcaactctctgaacacagtgttggtcaaaataatgtcttcagcaaacgggtaagagcaaactccactaccctgccctcctccccttccacccggcttccaaaaaaaaaaa

SEQ ID NO: 468 - DNA, 242 bp, dog
cgtacgtaccagacactgtcctttctctgctttctcattgattttcacagaattcctgagaaagggcactcttttttttttaccctatattttccccacatgattgtggcctaagtaattgaccagttcttggctttagttcgtagatagcagagcagggggtttcagtcagcctggtctactccccagtatgcagggcaccagtcattttgtcatacacctcatccttccaaaaaaaaaaa

SEQ ID NO: 469 - DNA, 217 bp, dog
cgtacgtaaccaatttaatgatgaagcagccaagatctggggtgcctgggtaactctgttaagggtcttcctttggctcaggtcatgatcttaaggccctgggattgaaccccatgttgggctccctgctcagttgggagtcggcttctccttctccctcagctgctccccaccccacttatggactctctctctctctctctctcaaaaaaaaaaa

SEQ ID NO: 470 - DNA, 137 bp, dog
cgtacgtgcagaaaagaaagccctttttgggtgtgtctgtaggctagacttggcataagaatagctgtgggcagccatttgatacataaaattcactgtgcttctgcaaccggaagcaattagtccaaaaaaaaaaa

SEQ ID NO: 471 - DNA, 127 bp, dog
cgtacgtagggagggagagagagagagagagagaggagagaggagagaggaaggggcagagacctaggcagagggagaagaagcaggctccacgcaaggacacaaacaaaccttccaaaaaaaaaaa

SEQ ID NO: 472 - DNA, 129 bp, dog
cgtacgtacgaacactggcatcttggactgtctggctactgaagaaacaggggaggattgtacttttctcattcacagagttgtaatttctcatccacccagcatgcgactctcctccaaaaaaaaaaa

SEQ ID NO: 473 - DNA, 340 bp, dog
ggtgaacccacagctatcctccaaccaccccccctccaagagaggtgaggaatttgggtagatcgagctcgaactccgttaaagttttcaaagatccttattccaccaagtggtgacaatctctcctctgaacccctggctctgggacagcctataggagggtagggggtgagaagtagcggtcctttgccttgttttctgtcacaagaaattggccacttagcatgtctgcttttaacctggcgtaagtccgtgctcctttcttttcatggctgctttgcctgagttaacacgtagcaggtgcttagtttctgtggccccccccccccaaaaaaaaaaa

SEQ ID NO: 474 - DNA, 242 bp, dog
ggtgaactaggagcagtccctcccatttgggatctgaaagtgtatgaccacacaatgaaaaagcaaaacctgaggagaaaccacttagccagtttctggaaaacatgcagtccacatactggtgaataaacagaaagcagatcaacacaggacctttgaaaggctgtgtcagtacagaaggacctgacccatgaagtgtgaaggaagagcatgtatgaaaagatttgttccaaaaaaaaaaa

SEQ ID NO: 475 - DNA, 237 bp, dog
ggtgaactatatgtcatactttcttttgttgccctaacaccactttccctatgaaatctgccctggccgctctatttaaaattgcaaagggcgtccgaatggcttagttggttaagtgtctgcctttggctcaggtcatgatctcggagtcctgggatcgagccccatgttgtctgcttctccctctctctctgcccctcctccctgctcatgtgctctctctctcaaaaaaaaaaa

SEQ ID NO: 476 - DNA, 185 bp, dog
ggtgaacccaatggaggggcatcggctgctacttctctgggatccttatgcaaatgaatccactcccaacagccttcccaggtgcctccgaagcacctaacctgttgatgctgccaccacctcttatccccactgtttccactatatggaagcataaatccatttaatacatccaaaaaaaaaaa

SEQ ID NO: 477 - DNA, 122 bp, dog
ggtgaactcagtcagcccattgtgcctcaccttttccttcattaatacatgcatagaatcttccagtgagggtagtggtttctcagcgtagtggttcattagtttgttggcaaaaaaaaaaa

SEQ ID NO: 478 - DNA, 385 bp, dog
cctgcaatggacaaagagataacctgtatacatacaagctcagtggaattactttctattttgtaatgttttctttgcatcccaccagtggtataaaataatatgtgcttagtttataaagaaggaagtttaaactcagatctttatcgatgaagcttcatcagtgttctaacaacaaataaagtgacggcctgaaaatgagttggcctcttgttcctaggttgacttctttaaagtcacagcctttcacatagaggtgtattggtccaggcttgctacatcatggaaataccaaacacatgacattttttcaaggcagaaatattgtccctttcaaatgaatctgaatggtcaaacttcagtgtccatcgtgcaaaaaaaaaaa

SEQ ID NO: 479 - DNA, 193 bp, dog
cctgcaaacacaactgccttcctcgctgcttccccagcttgtaaaactgctgcttttaatgttgattataactgcaacaagtttcacttcctaccaaagtaataaagacgtagaattctcaaactccaccccaggacacccttccagccttctctgcctgccctggcctcggtttctcctccaaaaaaaaaaa

SEQ ID NO: 480 - DNA, 124 bp, dog
cctgcaacctttcaaagagaactgccctccctggcctgggttactcctgcagggctccctctttgctcacccttgctgaccctgtgagtttcagtcaggaaagcacctctcccaaaaaaaaaaa

SEQ ID NO: 481 - DNA, 127 bp, dog
cctgcaacaaacatcagtgtgtgattctcacaacaccagaaatgagtcctaagaatacctagtttagttgtaagagaccatataaaggaatatggaggtacccttcccccccccccaaaaaaaaaaa

SEQ ID NO: 482 - DNA, 480 bp, dog
gctgctccccttgctcatgctctctctgtgtcaagtaaataaaatctttaacaaaaatgaaactgagcttaatatctttcttccaaaatgtgatcctgtcttcactttttccattaacagttttacaactctttatattcactgagctggaaactgaggactgtctttaactcttcctgccctaggctccctacaactctggatagtaagtcgtatcaattatatctcccaagtatcccttcaaacccaccccctcgtccctgttgctccctgaggtcaggaccttgtcctctattgcccaaactaatgctggaggcttttactagcttcccccaacccttttttgcagccagagatctttctgaaacacaaatcaaactgtgttactcctttgctcatacacttccactggctcatttctgctaagataaaatctgaactttgcattagctggtactcatcatctgccaaaaaaaaaaa

SEQ ID NO: 483 - DNA, 632 bp, dog
agaggcagaagcgctatcatgaagatatctttggtgctgtgtttccctatgaggtgaaaaaagatggtgcagcaaaacagcccagcgatcccagagttccagcagcccacggaagaagttaaagttgctgccatagaattgaatgatgaaaccaactctcgattatccgagggcacagggcctggggagatggaaggaaattgcatccccgagcctcatatctatctccccagctgcttccccaccacacccgatacttgacctggactgtatagcaccccagactgagtggaacctcttgtctcccttgagcccaccctttccaggtaatggagagttgggccttccaggtctcttgaagactaaatctgcagtgccaggcccagctgatgggtgagaaggatggcactttcatctgattgcaccactttgagtgaccagcaggagacgatgtcgtcctgccctgtatttatttgccctgtgtacagttatttataactctgtatttaaaacaaaacaaaacaaaacaaaaacccagtcttctcttaagggccacttgggccctccctgtatgactccttgatggagatatttatatgaaatgcattttattttaaccacaaaaaaaaaaa

SEQ ID NO: 484 - DNA, 154 bp, dog
acgcaaccaccaaattgttgaaccctacatctgacacaagtgatgttctatatgttggctgattgcatttaagttaaaaaaataaaaaaataaatagattcagtggcttgcaactgaataaataaatagtccttttaaatgccaaaaaaaaaaa

SEQ ID NO: 485 - DNA, 305 bp, dog
tagagcgaatgtcatggtaagaaatgttagaattaaaggtctgatcagacatgaaatgaaccatttttacatttcaaaaagaatccagggaagaaaaaaatattttagaggataatcattgaaatgttaattttatgtttgcatgaaatagatcttcagctgttatctgtaagcagctattcggatgaatcagagtgtaaggaaaactggttattgaccaggtaggtaggcctttggaaacaagtaagagaatgtgagatataaagaggctggtttcagttttcagttctgtccaaaaaaaaaaa

SEQ ID NO: 486 - DNA, 303 bp, dog
tagagcggtaaaaaaaaacggggggatgaaaatctcttccttcatggattctgataaaggaagacagatgataaaccagtaaaatcaacagcttgttgattttcagatgatatggacagagaagagatgggagtgcagtgatggaaagtagagaggaagggtttcagttttttagagtgtggtcagggaagccttcctgagacagtgacagagcaaagccctgaaaaaggtaaggtaagtagccatgatgatagggttgatgaaaatttccagtagaggaaacttctagtgcaaaaaaaaaaa

SEQ ID NO: 487 - DNA, 178 bp, dog
tagagcggtagtagtcgcgtatttaagaatacattcaggtaaacagccagccgcaccctgtgtaccccttcagtggcaaagaagctgttccagtctcctgaaaatgatcactacgagtgctataattctgaatgtaatgtctcttaattagaattcatacaagaaccaaaaaaaaaaa

SEQ ID NO: 488 - DNA, 234 bp, dog
cggcatagtactagtcaggatgatgtggcaggtgtagaagaagccaaccaagggtttcctgctgtgcaacttgctgatgcacaggtgagccagtctgtttttctgtaattatagtaacccctcattaggtagttcttagcagctggaactgcccagttatatgcacctgggaattctggtgaaaaatctttttttctgtgattgtctgtctgagtcttcatgcaaaaaaaaaaa

SEQ ID NO: 489 - DNA, 302 bp, dog
tagagcggtaaaaaaaacggggggatgaaaatctcttccttcatggattctgataaaggaagacagatgataaaccagtaaaatcaacagcttgttgattttcagatgatatggacagagaagagatgggagtgcagtgatggaaagtagagaggaagggtttcagttttttagagtgtggtcagggaagccttcctgagacagtgacagagcaaagccctgaaaaaggtaaggtaagtagccatgatgatagggttgatgaaaatttccagtagaggaaacttctagtgcaaaaaaaaaaa

SEQ ID NO: 490 - DNA, 305 bp, dog
tagagcgaatgtcatggtaagaaatgttagaattaaaggtctgatcagacatgaaatgaaccatttttacatttcaaaaaggatccagggaagaaaaaaatattttagaggataatcattgaaatgttaattttatgtttgcatgaaatagatcttcagctgttatctgtaagcagctattcggatgaatcagagtgtaaggaaaactggttattgaccaggtaggtaggcctttggaaacaagtaagagaatgtgagatataaagaggctggtttcattttccagttctgtccaaaaaaaaaaa

SEQ ID NO: 491 - DNA, 132 bp, dog
atcgctctaaacaaaaacatcgcagattccaatgacataaaagaacacaaattttatactttatataaagcaatttgctgtggtaatttttcctttgatttttcaaaatgatacagatggcaaaaaaaaaaa

SEQ ID NO: 492 - DNA, 324 bp, dog
gttgtgctaataggccaacattttaaaaccctacttccttttttcataccaaggctatttctgtctagaccaaaaatgcaaacagaagtaaaactaaaccaagcagttgaaagccaacctgcttgcctcacatatgtgataagcatgacctttagggattggtagattggtgagattgaggagaggattgttcttgctgagaatgtgaatgagaaatcatactggtttaggagaaattaaagagccccttctgcccatacagacagactgtcttggttccccatgttcagatatggattgtatctccccccccaaaaaaaaaaa

SEQ ID NO: 493 - DNA, 132 bp, dog
cctgcaatacacccctttgagcaacttctctaaagagagctctcgtttggaaaccatcaagccaagggcagcctcctaaaatacttacagcccaggaatgctgggaaataagccccccccccaaaaaaaaaa

SEQ ID NO: 494 - DNA, 114 bp, dog
cgtacgtatcatcaaagtgctttgcacagtggttatctggaagcaatgtgacctcttatcaagttcaccacatcaacattcaacatgggatatcattctttacaaaaaaaaaaa

SEQ ID NO: 495 - DNA, 397 bp, dog
gctgctccctagccacaccctgcagggcaggcatgccaagtaagtcattctctttctgatcttgtctttacatgtattgttcccttggcccagattagaatgtctccactcatcccccaagactcaggtccattgtcacctcctctgggggacttctctgagcactccttactccatcagccattgcacctccttccatttcaatactcacgttttggggggagcctgggtggctcagtcagttgagcaggtaagtgtctgactcttgatttcaactcaggtcctgatctcatggtgctgtctagctccatgctgggcatggagcctgcttaagattctctctcttcctctccctctgcccctctcttcccatctctttccctctcaaaaaaaaaaa

SEQ ID NO: 496 - DNA, 230 bp, dog
gctgctccaatggtatgttcataaatatcttctgaatgctctttgttaccaactggatatttaactgtttctcaaactattttttctcattgtttaaagcttcctctccccatattgtcatgaggagtggtacctatgtgttttcgtttattctactccctcatttttagtttggttattctaccatactagctgccttgaatattttgcttccatttcaaaaaaaaaaa

SEQ ID NO: 497 - DNA, 215 bp, dog
gctgctctcgaaacttctgccccttgcctctcacttgttattctccatccttggatgtcagggacctggatttactcattctaggtgcacatccttggagtaaggcatgctgcccagtcagcactcaaacaaaaaacaaaaacaaactccccctaaaaaaacaaaaccaaaaataatttttaaaaagcccagctcccccccccccaaaaaaaaaa

SEQ ID NO: 498 - DNA, 209 bp, dog
gctgctcctttaaagtcaaaaggcagagatctcccaccctgtcctgctggtccccccacttctgtggaggcctctgtctgcccctcatcactttctttagacactctctgggaaacatccacctgttgggctcacacttgcttaggttcctcaggggcccagcacaaaaaacttaggaaatttgctttgtgagatgccaaaaaaaaaaa

SEQ ID NO: 499 - DNA, 166 bp, dog
gctgctctaaccgacagttactggttcctcaggaagttaacgggacctaccaggtcctgccagtccactcctgcgcgtggacccaagataactgaaagcagggactcaaacagatgcttgtatgtcggtgttcatttaggtcattcacgatagccaaaaaaaaaaa

SEQ ID NO: 500 - DNA, 156 bp, dog
gctgctccctgaagaaccttttagtgtgtccgttgctacacaagataaatatttttctgaggcaggaggttcgtctcttccagcttaaatctgggactcagtgaagaggaggaaaccatgttgttttccctgacattgtgtatccaaaaaaaaaaa

SEQ ID NO: 501 - DNA, 149 bp, dog
gctgctccccctggttgtgtgctctgtcaaataaataaaatcttagaaaaaatataccctcccccaataagaccatttaagtgtgtcttaactacagaatactaactaaaaatgttggccaagaccaaccccccccccaaaaaaaaaaa

SEQ ID NO: 502 - DNA, 139 bp, dog
gctgctcctaggtaaaacaactagccctatctcatgaggatgtagacagaacattctgaaaaattcctagcactgagcctggaacctggtgagtgcttcataaatgtttagtaaaatagtgctggaggcaaaaaaaaaa

SEQ ID NO: 503 - DNA, 133 bp, dog
gctgctccctgctgaagagatactctgtgagtgaattagtgtgcccttttagactgtctagggctgggccttgtccataccctatcgctctctcaaataggatttgaagtaaaatcgtccccaaaaaaaaaaa

SEQ ID NO: 504 - DNA, 266 bp, dog
cagcagccggacaatccagaacatcccaggtatttgtgtctgagtataggaggactattatctgacctgtgatcaagctggagtacgcaagactaagctcttgggggagaattctaactttgttgttttgtttgtgcatcctttttgtgctcctttcgtgatgagtaggaaacatttttattggtgtgtgaaactcacattttactcctaaaaggtagcattcacaatattacatatggtatcatctaaactgtgcaaaaaaaaaa

SEQ ID NO: 505 - DNA, 205 bp, dog
cagcagccactaaaactcctccatctcaagaaaaagacgaccctggggcgcctgggtggctcataggctcaggtcaggatctcagggtcctgggatcgagccccatgttgggctccctgctcagcaggaagtctgcttctccctttccctctagccctcctcccttactcatgtactctttttctctcccccccaaaaaaaaaaa

SEQ ID NO: 506 - DNA, 257 bp, dog
cagggcaacgccagtcatcattatggctatctgtaggactggtggccagtgtcctgcaggcacaggtccttaatcaaggaccagagaagcatatctaacaagctgcaattcagataagcttgggaaaaagaaaaaaagaacgcacttcaccagggctctgctcagtgggaagaaaaccgtattgccccagagaagacatatgggaaaaccctagaggttcttgatggtcattatggtataatcgccaaaaaaaaaaa

SEQ ID NO: 507 - DNA, 210 bp, dog
cagggcacacaaatggaagcaataggatccttgtcctcggtagagtcacaatgacgaccccacattcggtgctgaggtctctgttcaacaagaatcccaggccttgtcagaacaggatcatagggagccccctctgcggggcaatctctgaacccgagatctcccccgttcctactgcactcagtccctgcccccccccaaaaaaaaaaa

SEQ ID NO: 508 - DNA, 182 bp, dog
cagggcacaaagacatgaggtgttaaatcatccacaaagaatgagtggcagggcaccatggggggtgggggtgggggtaagtgcccctttcctggaccgatgcctgctcagggcctatcccattcctgccactcccagggcctgtgtgatctcagcagagagcgttgctacaaaaaaaaaaa

SEQ ID NO: 509 - DNA, 182 bp, dog
cagggcacaaagacatgaggtgttaaatcatccacaaagaatgagtggcagggcaccatagggggtgggggtgggggtaagtgcccctttcctggaccgatgcctgctcagggcctatcccattcctgccactcccagggcctgtgtgatctcagcagagagcgttgctacaaaaaaaaaaa

SEQ ID NO: 510 - DNA, 878 bp, dog
cgacgctgattagttaattgtctcttggctggaaaaagtgctttctctctactgagagctcacaaattgcaaacctggaacctccaggtgggccttcccgctccctctgcaatcccaccaaagagattctgattggcccagcttgggtcaggtgcctgcctctggaccaatcaatcaaatgtgtccagtcaggtacttgcctcagaaatagggctgcattggacctggctgggcctccagccccgagggcatgccccggacaggccacacctgtgacactagggtctgctgtgtggtgccctaagcctgcactggaaccttccagatctcagatatcctgtcctgttagtcccaggcccttgcaaagactctgaaattctattttcttcacacctggagaataggctggtaataccactgcttgccattttaagcacctgccttttgcagccctgggaagcagatgccctcattatagatgcatattctgaaaagtaagactgtgatgtggtgaggtggagagactcgcccagcgtcacaagtcatttcagaaacgcccccagggtccgagcactggaaggagatgctctggtgctaactcctaccggggggcagggccaggtctgctgcgtcccccttcctgccccctgtgtgtggcatagcgcttgccacgtaggaggtgctcaacagatctctgatgagtgaattaatgtgtcaatattttctaggtaatctgtggggggcagggatgagccacaattttaagaattgctatttttgagtatcccctttgcctttttttcccatgcttcccccaagcctcctcagctctatcagtggcaacccagcccatccagtgtttcttgcaaaaaaaaaaa

SEQ ID NO: 511 - DNA, 627 bp, dog
cgacgctctaggacaaaacatgaaagaaactactgaagaatcttaattatccagaagaaaagacctagagatacttaattaggaatctccctcccccaccaagaaacattccagccacatgcccctacagggaagactgtacagttgaacagtaatgcacagaggtcccagtacacttttaagttcaaaggatgactggacaacctgaaggaaaaatgtatagagtgaaagacactaaaacatatgaaaagaaacttggaaaaaataaattcaagaataagaaaattcaaaatattctcattagtatgctcatagaggcaagaaaagatatgtcttcaataagcaagggtggatggcttcatgttttatatacatatctaaaggacaaccaaagaaaaaactgttagaaagtaagagtttgacagtagactttaaaaatcaatcaacatcaaggatgcttagaaggtttagtagattaagcatctgcctttggctcaggtcatgatctcaaggtcctataatgtagccctcaggctccctgctcagcagggaatctgtttctctccctttccctctagccttccccgccaaatcatgctttctctctctctctctcaaaaaaaaaaa

SEQ ID NO: 512 - DNA, 553 bp, dog
cgacgctgccggtgaggtttaagggatgcttacttacacaaaggagggaaaggtcgagtgggctcatctgctcattcatttttctcatatattttctagaattcttgtcttgggccatgcaccacgaaaggctcttaagattcaaggggaaacgggagtctcagccatgcagaactgtatggtcaattagggcaaagtgcacaggatggaaatcctcctgcctgcagcacttcggtctagggggagctcctccgacatgggagcctccacatccaccatcattacatactttcagcaggtcagagagctaaaatcacagaggaggagatgtaaagaaggagcagggaagaagtttttcttttccttcttcttttgggtccattttctttccaatacttacaaatcctcacatgctgaaaacagtgaatctacgcttcatcaacatgatcgtttgcagaaatagtctgcgggacagatataacagaatttaactaatttgtttatactcccgacttgttcccaaaaggctttgaggcaggttcaaaaaaaaaaa

SEQ ID NO: 513 - DNA, 413 bp, dog
cgacgcttaacccctgacctaattgcagttccagcctctcccgggaatggaattttaaatcaatccgttcggaatttcctggtcagcactaatcctcctgataaggtaaaaggtcatcggcctgataagacccctgcttcgtaagggaaggtgaccttgccggaaataatccaccctcaattccctcgtcccctctacccctgctttgcctataaaaaccttccttctggtacagtttcttggagcgcccttccatctgctggatgggacgctgcccaagtcaggaattgttgaataaagccaatgagatcttccagtttactccgctgaattttgtttttaacgtcttttttatatatatataaaatgcagtatgcatagagggaatacacactcccccccaaaaaaaaaaa

SEQ ID NO: 514 - DNA, 396 bp, dog
cgacgctcaacagaacaaattactaagtgtggtagctggggaactggctagagcattcatgtctaagaggaggctcaacctcactataatggactgcaaatgtgctgctatttaactccagactccagatgtgactttatatgctaaaggtaaattgcactcgaacacatgctcactcatgttcaatacataaataaaggccttggtttaaatttcagcatgttagggaacaaacagttcttgttacttatgactccccactgtcttctaaggaaggtgggtcctgattcctggaggatttactaaatacaaactttattcccagtgtaagtgtctttggaaaaactttgagaaatatcacacattgggggagaggggagattgcaaaaaaaaaaa

SEQ ID NO: 515 - DNA, 373 bp, dog
cgacgcttgatgccgtttcgaggagaaaggaggacgtctcggcccatgagccttgggctctgctttctgccctataggatgtattccttccccacttaaacttcattccttctgacttccattcttagatctccagaattagaatgtctaatcctctcatgctcagaacacagagtaataattattcctgctgcgcttccgcagtaccagcccgtgcctcctatctgggcactttcttcctaaacatcatttaagtgcaacagtgagaaaatagagtagttcaagaggatgggataggaacctcattgcagccactctctggacaagtcgttttctctgaacaattcggagcacccccccccaaaaaaaaaaa

SEQ ID NO: 516 - DNA, 298 bp, dog
cgacgctggcaagcaagagctccaaagatgtttcaattcttctgtgtattgattttatatccttctactttgctagagtcttttttgcttgagttagctttatcatgggggggaaaactggggttttcccagcatagcagcagatctttggcaaacagggagagttttacatcttctcgaccgattcttatcccagtaattgatttctcttatctaattgcattggctaacactgctagaagacaattgtactgacggagaagaatacacagctataatgttaggtcaaaaaaaaaaa

SEQ ID NO: 517 - DNA, 277 bp, dog
cgacgctagaacagcgaatacatcttgacaaagaagaaaatgggacgaatcactctatgtgacattacatactatgcggctgcattaatcaaggtaccgaggtattggtggcaggacagacgcatagatccatgggacaggagaacccagaaatagacccacacagatacgctcaattgattcttgacaaaggtgcaaaagcaattcagtggagaaagaatcgtctatttaacaagcagtgctggagacattacccaccaagaggcaaaaaaaaaaa

SEQ ID NO: 518 - DNA, 150 bp, dog
cgacgctgggctaagtggctctctttctccacgtacgaaaatgtggtgctgtcctgtagtatatcacatttcatgcagtgcagcctgccctgatttcaacagggtggccacttttctggggcaaaaacagataatacacaaaaaaaaaaa

SEQ ID NO: 519 - DNA, 130 bp, dog
cgacgctacaccaccgaggaggttgagcaagtacagatccctgggccagcccctagggcactttcctcatcaggtcaagcagggactgggaatttgtacattaaggaagccccccccccaaaaaaaaaaa

SEQ ID NO: 520 - DNA, 303 bp, dog
gggcctaaataaataaatagccccccatgaatccccctagagtcttcaagaagtaaaccacttatttcgcagcaggttctgggatggcaggtcctatcgtgtcagatatgatggctcataaatccaagtcacctgtcctaactgcagttttaatccactcacacgtgcttagctgggtttaattataggcagaaattgcatttcggaaagcaacaagaaatcacttacatggcttgaatttatgcattaaatgattctgttcatttgagagtgtggtaggggtggtgtgtccaaaaaaaaaaa

SEQ ID NO: 521 - DNA, 288 bp, dog
gggcctagagagacaccctgatcaggttcccagaagccagcaaagggccagccttgcaaacagcctcgagcctgccctgttaactcttttttgcacgtggctactcatcatcctggtgatgaaagaagcagctcgcctttactgagtgcttactctgtgccaggcgctaattgcagcactttcaatgtgctgatttcatctccctcccagatgccatccgagtaccgtgaccatccaggctacagaccttctttgcactgggagcccctccccccccaaaaaaaaaaa

SEQ ID NO: 522 - DNA, 185 bp, dog
gggcctaacctgtgctgttgccttcttgtaaataaggttttaccataaaatagccatgcttatttgtagatatattgtctgtggctgctttcatggcacaagggaagtactgagcagttgtgacaaacagtatcacccacaaagcctaaaatatttgctctttggccctttacaaaaaaaaaaaa

SEQ ID NO: 523 - DNA, 143 bp, dog
gggcctagctgaagaaacagtcacatgctcaagcaattgaaaactcctatttattgatctggaaagattttatgatcatcccgtatgatcaataacttctagtgtgtatgtacattgtataatatcccccccaaaaaaaaaaa

SEQ ID NO: 524 - DNA, 339 bp, dog
ccagtgcatataaaagttacattcagggcacgtgggtgactcagttggttaagcatctgactcttgatttcgattcggatcacgatctcagggtcgtaagatcaagcccctcatcaggggcttgtgctctacacttgtgctggctgtagagcctgcttaagattctctctctctctccctctccctctgcccctccctcccccatcctctctcgaaaaaaaagttatattcacagtatactatgtaaaaaaagtttagtaagcatgcaacagcattatcactaaaaaaaaaaaatgtactccccttcattaaaaaatggtgtattgccaaaaaaaaaaa

SEQ ID NO: 525 - DNA, 336 bp, dog
ccagtgcagatggggacccgggctggaccttcccgcacccaccccaatttctgtttgaggtttcttaggtctctttcactgctcagcaaaagccttcaatggaggggggggggtcgctgggggggcatgtttacaagaaaacagagtaatccatacccagggaagaggcggcgtgagaaacccaagacgctgaggaaggcatccctctttatctgctggattggaggccagctgtctgtgcaacagaccatctcattcaccgctcagtggcaatcagggggatttactgaggccatcccagcaggaaagcaaaaccaaccccaccaaaaaaaaaaa

SEQ ID NO: 526 - DNA, 293 bp, dog
ccagtgcaaaaagggttgagctgaccttggtttctggaaatgcaaaatgtcgtcaaatccaaacatgcctgtgaaatctaaactcgctttcatttcttaatggccactctcagcctgtaaagaacacagacagatgattgcttactaggcacaaaaacagaaaagagtgtccatgcttgtgccaggtatttttgcttgctaaagtagtgctttctagccaatctcttaaattcttccttcttttatgtttgtttagtgtagtgattgacagagcgccctaccaaaaaaaaaaa

SEQ ID NO: 527 - DNA, 221 bp, dog
ccagtgcaggtggttgtgaggcatcacaggcattgggtttgtgtctctggacaaagcctaaaatacagtagaaaaatgtttttaagactcctttaccaatggaaactctggcctgaactatgataggttctttgattcgggacttagtgttttaggaatgaccccaaggactagagtcagtggtgaaaatgaccacatgtttcctctgccaaaaaaaaaaa

SEQ ID NO: 528 - DNA, 230 bp, dog
ccagtgctacccagggttctactagtaggaggaccaatcctctttgtcctgctttctgtcatgatgtttgcaaagtgccatagaagtttttggaacattcacaagtagaataatagatgttcccatagtttcaagtatttattgagagatctacctgtggggtctggatcttgtaaggcaagtaaggcactagtcttggcgcaaaatttcaggagtgccaaaaaaaaaaa

SEQ ID NO: 529 - DNA, 209 bp, dog
ccagtgcaataatgccacagatagatctacctctggaggggaaatggcagtgtcagggctccccccaatttcatgcaggcagggttcctgcaaaaacagtggtggtcttacagtctctcccagggagatggggatgagagtggtgttgagatggaagggaagacatggtggtggttctttctgttgtacttttctcccaaaaaaaaaaa

SEQ ID NO: 530 - DNA, 197 bp, dog
ccagtgctaaaaggcgggccctgcactccccacccgctgccaggggggtggagaacaggtggagaacagggagtaaaagccttgaaaggatgagtgccaacagtttcactgacgggaatggatcctaaggaagtaacaaggaacgagcagggatatcatgatgtgctcattaatacgtctgattgcaaaaaaaaaaa

SEQ ID NO: 531 - DNA, 176 bp, dog
ccagtgctggccatgataagcccacctgccagtgaaaaatcacttgaacacgcgagagatgataagagaaaagaacaactctgtagcctcgagacatgagacaaacacaatctgttgatatagtatcagagaaaatacaactgacccttgaataacaccccccccaaaaaaaaaaa

SEQ ID NO: 532 - DNA, 330 bp, dog
tcccagccataccctcttccctctttaaagtccctttaaagagatcaggagggaggaatccaaccataaaaggaccacatacctgcaaactcgctgaggggagttccatcgactccgtgttgcagctgcagagatgaaagccaggcctctcacggttatgcacgcgaaccgtcaccaggcatgagggaagaaagcacaaatgtccacctttctcccactccgattgccaccctgggcccttgggacttgccatagcaaagctcgttaatgcaagggcacgttccaagtaccatcgttctagatgccctccccccgccccaaaaaaaaaaa

SEQ ID NO: 533 - DNA, 316 bp, dog
tcccagcccctagaacagattagactactttagaaggggtcctagaggccacaatggcagagtagcctcgtaagctgtctctcttcccagaagacttggttggggcggcaacccatggactgatttcagtgcacagaaagaaaacaaaaccaaactgccaaggaaagagggggtctccaaagttggaatcacaaattaataaacaatgtgctagaaagaaagggctcaaataatggacacctcagtagaattggatcactgacacagctactgcttatggtccactcttatgccttactctatccaaaaaaaaaaa

SEQ ID NO: 534 - DNA, 307 bp, dog
tcccagcaccatttgttgaaaagattgtcctttccccattgaatcatcttggcagtcttgtaagaaaaaaaagatcacttgaccttatatgcaagggtttatttctgggatctctgtttttacactgaatgcttgtctttgtgccagtaccacattgttttgattattgtcactttgtagtgaatttcaggtcaggaagtatgagtcttccaaatttgtccttttcaagattgttttggttatttgggatacttgagattccatatgagttgtaggatgaatttttctatgcctacaaaaaaaaaaa

SEQ ID NO: 535 - DNA, 245 bp, dog
tcccagcccagtagagagcatggacagaagttcaaaagctactggtaaaggatactaatggcaacactggaagtacttgtctgaatcactggttttggaaacctctacccctgcgtacattttcatgtcttcattttagtttcctttgaacattttaaacacttcttctcccacatatcctctcacacttctcctacgcactcccaatcctctgactctcccacatacgtagccaaaaaaaaaaa

SEQ ID NO: 536 - DNA, 212 bp, dog
tcccagcccagatgctatctttataatcattgttttaaactgtacttagacatcatatatgtgtattgatgaacttcctggctgtgagtactacttcatgttattttatggagttgaatttctccatctcactattgtttttcagaaaagaaagaaggaagaaaaaggaaaaccaagaaaaacaataacaactaccctcccaaaaaaaaaaa

SEQ ID NO: 537 - DNA, 176 bp, dog
tcccagcccacagacacacgctgggcacagtgagcactggagacccctggcaccgcccccacggggtcctgcggtctctccccccttctgagaggacacagtcactttggatgtagggccccttccttcaagcagtgtgagctcattataactcattacatctgcaaaaaaaaaaa

SEQ ID NO: 538 - DNA, 170 bp, dog
tcccagcataaaaagggcaataagcttctccgggaagagaaaaccaagctcacgggaatgaattacaagaaacttccagacagcaagcagacagaaaaagagtccatagactcaaggtgggtgagaaccagggaatcacagcaagtcatgaaacccttcaaaaaaaaaaa

SEQ ID NO: 539 - DNA, 165 bp, dog
tcccagccatgaaatgtatgatatgcatataatcacccctgagccatcatccatgacaactcagtttgaaacaattaaaacattctgaacaaagaaaagacctgaagctccgctcctgtcctttctgttctctccccaatccagctgtcgtgccaaaaaaaaaaa

SEQ ID NO: 540 - DNA, 360 bp, dog
gtcagccccaagaaccaaaatgccactctctcctttcctgattcattttattattttttactattaaatattctcaggatcagtcagacaatcatttacatcaacacatagcctgtgtccctcattttttttttatttcaaaagcagggcagatgccaaacccaggtgagagcttcccagccagtgggtggctactgttccctgctcacccgaccagagacttccaaaagggcttccctttttctcctgaaggcaatccagtaagagtgcatatctcttccacagaaagaagtcaaaagacctcctctctctccttttcagaatccatatgccaaagaagccttgtcccaaaaaaaaaaa

SEQ ID NO: 541 - DNA, 345 bp, dog
gtcagccttcatgttgtgaccccctacactcagtccacacagtcacggaaagacacccctgccctgttcattgatgtagctgtgtctcctcaaagagctgattattttcgggaagttctcctgggggcatgggctccagcagccatgtcttctctatgtacttattaattagctcgtggagtgggaaattataccctttccttatgcattgttttttaaggatttgagctcattgtctaaataaacagtgctcttagaatgttccctcaagtagaactgctaatctcacctcatattcttgctaaaatagtgtaggatatgttcccccccccccaaaaaaaaaaa

SEQ ID NO: 542 - DNA, 310 bp, dog
gtcagcccaagtaaaaaaatgttagctgtcccatgggacctggggtgaggcggacagcccctggttagggtgcctgtctagaggtctgtgctgtctgtcatggctcctgctgtctcacagaccacatagatgcatgtcaagcacgttccttagccttcctttccatgtctccagagctccagtctggtgctttacacataagctcactgaatgtctgttgaacaaatgaatgaacgaacgaatgaatgaatgaatgaaaaccttttaaaaatttcctgcttcctcaggaacttcccccccaaaaaaaaaa

SEQ ID NO: 543 - DNA, 245 bp, dog
gtcagccaacacaatttagagccctcttatccagccagttgcatgaagacaccattgcaccatctgcgtcattagcagacagttgcacagggttgcgagctaatttatgatttggagattgctgcctgtggcataattcacccggggaagtaaagcctaggtcaatatatgtttaagtaaataggttctggaaagcccccaggggtcaagctgggaaagcagcctcagattgccaaaaaaaaaaa

SEQ ID NO: 544 - DNA, 200 bp, dog
gtcagcccaaaggagagagagcccatcacagggtcagtgctgggcaccacacagctttcccactctgcccccagccaggagcagcgccctcagttaacagcctgctctgggtgaggatcctcatttctggaaggtaaggcttctccttgtgcatgtccctctgtcaccagaggcctcctcccactctacaaaaaaaaaaa

SEQ ID NO: 545 - DNA, 117 bp, dog
gtcagccccatccaaggagtattgaatgagaaaatgttaggcaattgttaactggatcaccttgaatagataaggcaattctaaaggaaatagtatcgccccccccaaaaaaaaaaa

SEQ ID NO: 546 - DNA, 816 bp, dog
acggggtgatctcctaggtcccaaatactgagctgagtaagaggccagctgccaataatgtgtctagcagctccttcctgttcaggactttgtggttcaggacccatgtctgatgctgttgagctagccctccccttctacccacattccactggacccacattccacagagccataggttatgttctctggaaagcagactctgagatatagattagtttgaagatttattagggagttctctacggatcaccacctgtggaagcaaaggaaggaagcctgactgagcagagggagaagctatgctgtgacgcagtcccagccagccctatgggatgccaggaatggcccttcagagttgtcctgagttgaagcaagagggccaagcctttctactgccccatatccaccaggtatcagatgggaactggcctggaaaggaggcatagcctgggcaaggtgactctttagctgaggcattttctgaagaaggctgatagcagagggctgtctgctagtagtactccctgcagctgggagggtaggtttttcagtcccaaggaggatggatctgtgggaccatagtgtctgctatagaatgaattttctttttcttctcccatgtcatatcttccatctgctctgggtaggcaacgtaggtagaaagttacattctctacagtatggaagaaagtctgtgatttaaaatgccaggattagcccttgatatgttaaatgggagctaaaaggatttagaacattgttttattctcaacaatgtctggcttataaccacttatcttgcaaaaaaaaaaa

SEQ ID NO: 547 - DNA, 730 bp, dog
acggggtattggcaattcagagttcacagagtgacactgggtgtcacacgctgggtgaggggataccgtccctgagctcctttatagtttccttttaccacaggcacaaaccttaggttcaagaatcttagatgtgatgtgactcactaggtcactcgcgacgttggggctggagggactggttcctcgcagaaaggaaaaaaatccatcagaggaattaaagtaactccagagtagcagcattcggaccagaggtgcttgagactcaggggggcattccttccaggcatcattcccactgctcttccctcggcagagtaggacgggctctccaggggagccttctagacaaattgccttttagcagaggcccagggaggccagactccctgggggctctgcagccttgcacaagggtgatcccctgaatggcattggaaaccagctccatgcaggcagcctgcaacttctctaatctctgtcactgatggtgttaatctcgactgtcactgtgtgccagactagacaatgaaagcaagcactgggggcgcctgggtggctcagcgggtaagcatttgtcttcagctcagggcgtgaccctggggtcctgggatcgagtcccgcatagggatccccatagggagcctgcttctccctctgcctatgtctcagcctctctctctctgtgtctttcatgaataaataaacaaaatctttacaaaaaaaaaaa

SEQ ID NO: 548 - DNA, 425 bp, dog
acggggtgttatactatatgttggcaaatcaaactccaataaatatatatataaagaatgtgaccgatcaggatacgaaagcacagtcacttcattacaaacaggaataagattattaaccatgagaaaatgtgaaaaaaaggacttcatttgtgcagccactctttttaaaaaaaaaaaaacactttatttatttattcacgagagacacagagaatgaggcagagacagaggcagagggagaagcagggtccatgcagggagcccggtgtgggactcgatcccgggtctccaggatcataccctgggccgaaggcggggctaaaccactgagccaccagggctgcccaaccactcttattacctgtaaaatattgtggaatcacctggaaatagtaaaatacttaaacatgcaaaaaaaaaaa

SEQ ID NO: 549 - DNA, 414 bp, dog
acggggtacttacctatgagtagaattgccgggttacatgttgacacactatagagtgtctaccaatgtacattcccaccagcagtaaggtattcatttctccacatcctcacctacacttactatttatctgtctttttgatttggtcatcctagtgaatgtcaagtggtatcttattgctattctgattcatatttctctgatgactaataatgctgaaaatcttttcatgtttcttggccatctgtatatcttctttggagaactatcaggtcaaatcttttgcccatttttgaattgggctgggtttttttttttcttttttagcattgagttgtaatagttctttatgcattagagatacaaggggtctgtttcttatctctaaatctagaatgttccaaaaaaaaaaa

SEQ ID NO: 550 - DNA, 397 bp, dog
acggggtcacacacacacacacacacacacacacacacacacactgtaattctctctaacaaatagtcctgagtggagatggcaacatcacagtcattcagtccccagatttcttgcttctttttctaaaatccttgcttctgagatcttgaggttgcatgcctccttgggatccaacaattctcaggaatgaaagtttcttattaaagacctttttttcccccataaaagaatataatacttatttaacgattatcttttatttcaaagaatttcttcacaagtcatatttcaaggtgccatcctatgtattttgattaccaccttactcaacaatactccctatttgagttggaaactaaaaaacaaacaaacaacaacaacaacaaaaaaaaaa

SEQ ID NO: 551 - DNA, 311 bp, dog
acggggtactctggtaaatcagttctagattgagactgacatgaagattgagcttgtggttggaagatagaaaacagctgtgagcaaaattattcacctttgtgaggtaaacaaaaataagacacacatataagagaaggtagttatcattgttttccatgcaaactgtagaggagttgactcagacaaaagagtgatgagatcagtaatgcaatcagattcagggctccctgtcccactgaactaagacaatttctgtattcttgacaaacatcctcaaaaaataggaaccccccccccaaaaaaaaaaa

SEQ ID NO: 552 - DNA, 205 bp, dog
acggggtcatagtattattcagtgacctctagcaaagacaatggtcttgggcatttctgttgggtccaagagcccacaaatgatatctcgctcattttgaatatgtaggggttagtctgctgccctaaatggttctgttcattgtcacactttattttcattttctgtagttccctaactaactcgatgcatgcaaaaaaaaaaa

SEQ ID NO: 553 - DNA, 196 bp, dog
acggggtgaggaggaaaaaagatagatagacgcacaggagtgctatgggggcagagccacattgagagtcctagagacagaatgagaaagccattcctgaacagcctcatttcagttacggaaaattagaaagtttggtcacgtcataaacccacatactgacttgagtcagcccccccccccccaaaaaaaaaaa

SEQ ID NO: 554 - DNA, 191 bp, dog
acggggtgccaaactaaagccatagaactcctgatcttccttttcacacagccaaccatctgtctctggatcaattctgttttcttgcacgaatatcatttatctttgtcatttttttctctagagaaattattatgatttgtcttttcaaaaaaatagctattaatgtcagtctgtagcaaaaaaaaaaa

SEQ ID NO: 555 - DNA, 214 bp, dog
tgcaccgtggacagctgctgaatggatggccttgctgtcgactttttgaaattcttgataatttgtgggcaaggggtcgcccacattcattttgcactggcctgcacggtatcgtggctgctcccgcctgccactcggagagcctcggggcttagggacagagtccttcaggagttaacacgggaggtgggtgcacactttgcaaaaaaaaaaa

SEQ ID NO: 556 - DNA, 171 bp, dog
gaagcggaataaatgggctcaaatctctttggctgagcagctgtgtgactcaggcaagttacttagcctcttggggcctcagggttgacacctgcaaaatggaggtaacaatagtccctagattttataggttgttttgatgatcaagatagctggtgcaaaaaaaaaaaa

SEQ ID NO: 557 - DNA, 166 bp, dog
gaagcggtaaggttggcaggaaacacaacagtgggtatgcctccaataatactgcatttctttctcatttatctacagttatttttaatatcatacagcctattaaattagtttcagtgcctgtctctgccaaaataatgcaacttcagtagcccaaaaaaaaaaa

SEQ ID NO: 558 - DNA, 143 bp, dog
gaagcgggagacagcgctacaggccccatctacttcacagggtcgtccaaaaatgaaagaggacgttaaatgtccaaaaatattttcataacatgtaatcagaaagtcaggaagattttcttccttttttacaaaaaaaaaaa

SEQ ID NO: 559 - DNA, 241 bp, dog
ctccggagaacttggaatgttctcattaggcattacgacgggcatgtgtgctgggtgttctgcatcactttcagccttgcccacgcccacgggttgcctccacctattcagcattcactgagtatctaaccaagtactaggctccatgccagctactgtgattatgtgggcccctggtcacaaacaagctcatgatatagaggggcctcacagacacggatgggtcattcaaaaaaaaaaa

SEQ ID NO: 560 - DNA, 232 bp, dog
ctccggagaatgaatagcatggggacagcactctgatattgtgatttaataaagaatatataactggtcttagttcgagtcctggcaaacagatcctaaagtccttggaattgcctaagcatcaagaatggtaaaagtacctttatgtccatatgatgacttttggaaaagcccccaggtaacccagagacgagcaactgtgtgcctgtaaggaaccctccaaaaaaaaaaa

SEQ ID NO: 561 - DNA, 181 bp, dog
ctccggagattaattctgtttcctttcatattccacattgaagcctctcttgttataatttacttccagaacttcagttcccaggttacatgcaatattaaaagcagtggattcacacgtttaaattgctcttcttcctcattctcatgcttgttttcagaaaacacaccaaaaaaaaaaa

SEQ ID NO: 562 - DNA, 155 bp, dog
ctccggagaagagtcattcctgaggaaaactgaaaggggaatataaaagggtgaaggaaggaaaggcaatattgcagatctacaccgagcggagttcgctttcatcttttgggaaatttatttccacctgccccctccccccccaaaaaaaaaaa

SEQ ID NO: 563 - DNA, 138 bp, dog
ctccggagtgtgtgtgtgtgtgtgtgtgtgtgtgtgtgtgtgtgtgtgtgtgaacaaactggttctatttttccagagaactctaatctaccacatttaaaagaaatagacatagaaaaggatcatcaaaaaaaaaaa

SEQ ID NO: 564 - DNA, 132 bp, dog
ctccggagaaaggtcctatttacatttcctttgtttttattttggagtgtgcatgttttcttcttcacaggcagaaagaaagagaaaaagatagtggtgtaagaagccctggtctgtgtacaaaaaaaaaaa

SEQ ID NO: 565 - DNA, 186 bp, dog
ctccggagatcatactggaacacctccactcctcaaaaccctcccactgcctttcagtttgtccgtctccctttgttttgcctcccagaggtttacctttgcatacatttcagtttcctaaattttggagtttcttcaaccttgtcgaataactttggattccctccccccccccaaaaaaaaaaa

SEQ ID NO: 566 - DNA, 357 bp, dog
ggctgacccctatgcagaaagaaaaggtcagaagaaacagagcagattccaggtgataatatttccaaattctcttttttgcactaattggaggaagcctgagtaaaaccattcttgacttctgaagaatatccactaatatcctctctttcccataagcgctcaattcatagttcacctgcagccacaaggacgtgattaatgctctcatggatgtcttcatggctcctctcatgctgatcagcttcagagcttcagaattgcagccttcagccagctcagctccttctcctctcaggctgccccttctttactctaacagtactttccacactgtctacccagccaaaaaaaaaa

SEQ ID NO: 567 - DNA, 193 bp, dog
ggctgacagtcatacttccaagtaaaaatggtgttccatgaaaactgtggctagttgagctggcaacgcaaataccccacaaacacttttctttgggacaatcctcatacatgatatgcagcagaagtgtgtcgtgcattctttctgtttcatcaggaagaatattgaaaaaatgtgttctcaaaaaaaaaaa

SEQ ID NO: 568 - DNA, 140 bp, dog
ggctgaccccggctgacccctgctgaccctggctgtccttggctgactcagaagttcctcctctcagtgcctttaccccaccttccaatgtagggctcctgagttctcttacacaactgtcccttcgccaaaaaaaaaaa

SEQ ID NO: 569 - DNA, 136 bp, dog
ggctgaccatatacacaaggtgtttataaaatgtttgaaggaaagcacgatctaggtctagtggatatagctttgataactgaagaacaggataagtctcctttgtggcctttagagaatgatgcaaaaaaaaaaa

SEQ ID NO: 570 - DNA, 131 bp, dog
cggtcctggtcctgtgatcaagtcttgcattgggctccctgcagggagcctgctcctccctctcactatgtctctgcctctctctgtgtctctcatgaatagataaataaccccccccccaaaaaaaaaaa

SEQ ID NO: 571 - DNA, 136 bp, dog
atgcccgtagaaaagtcagtggcacgatggcagagcacagaggattctgagctcaagagaacaggaacagagtggtattgtgctccactgtatacatttatccccagctctagcacgttgctggcaaaaaaaaaaa

SEQ ID NO: 572 - DNA, 224 bp, dog
gcggtgaggatagagaacccgtggagagcagacacccagacacaggtaagctgagctccgtgcagcagaagctggtggaggactaaggatggttgaggaacagatgctgctccatcctcaagaccctccccaacaaatttaagacactgagggagagaacaaaggagacctagttgacatggtatttactgttgacatagcatccccccccccaaaaaaaaaaa

SEQ ID NO: 573 - DNA, 187 bp, dog
atgcccgatagagaaagagtagataaaacagtctcatcttaatgtctcctttgctccaaattctgctattgtagtttagtctgtgagatactaaaatccttactgggatcaacaccattgtctgtatttcgaatgtttcttcctatacagtagatacagtatagagttaactatgcaaaaaaaaaaa

SEQ ID NO: 574 - DNA, 191 bp, dog
gcggtgaggatcagatgagggggcccatatgacatgaaggaccttgggaacggcaaaatgccctataaatggcctgaaaataatctttgaacgtattaaaggtaacataggcatgtagataaatggacttacaactgccacacagtttttcaaatttcaatttgctatctttttacttacaaaaaaaaaaa

SEQ ID NO: 575 - DNA, 186 bp, dog
gcggtgatatggaagagatatgcagggcaatgtgaacaagggacctatagaggctattacagatagagtggtcggggaaggccacttggaggacgtgacatgtaagtagagtgctggaggataagaagccacatgcaaagagctagagaagagggaacagcaagggcaggtctccaaaaaaaaaaa

SEQ ID NO: 576 - DNA, 284 bp, dog
gcctttaaatataaatatcccaggagataaataaaatactgtcaacaatgacctgaaactgaatttttaaaaaaggataaaaagaggaagaaaaagagacttttctaaaatgtaaacttctataaaagctcctttggctaaactctgatacacagtttccataagattatgtcaaaggcaaatacagttcttcaaagtcatctccataaacagtagaaagctttagccatctaagcaagcaaatttaactgattccaactcccacccccccccaaaaaaaaaaa

SEQ ID NO: 577 - DNA, 168 bp, dog
gcctttaccatggaataaatcttcaagctttaagaaacagctttcattcccattcattttccatactggcctttgatgatatgcagatccctggtagcatgccttacctgcagcactatgtgcatttgctgtcacaataaagtatattttgtcttgcaaaaaaaaaaa

SEQ ID NO: 578 - DNA, 171 bp, dog
gcctttatctagaatttgtaactgcttctcttttgtatttacacactttctttcattgtaaaaacatgattaaaattgtcagctaatttaaagaagttgcccccttcccccacctcaccctttaagaaaaagagacaacaccaggaacttagcttaaaccaaaaaaaaaaa

SEQ ID NO: 579 - DNA, 218 bp, dog
gcctttaaataagaatcctgtctgatttatagtcttaggttttcttaagtacttcctcttgcactgatacgcatttgttttaagcacagatttgccgggtttttcaaaacgagaagagaacaagaaggattagaaaaatgtgcaactgtatatctgcttttttgttgtttttatgagcaattcgagtaaaatataatcatacttcccaaaaaaaaaaa

SEQ ID NO: 580 - DNA, 121 bp, dog
caagaccggcaagagaccctccttccagtttgctgtgacaccgtcttacgtgacgtaaggtacagataccccacttttcgaaagttcacgttacatagttttgctttgacaaaaaaaaaaa

SEQ ID NO: 581 - DNA, 318 bp, dog
caagaccgaagtacaggaaggtgaagatttaaaagaccagaagtaaaggtgaagaaaagacttagagaagataggaaaattggaagaaaaattacacgccttttagaagacaaaaataatttaaacctcgaaggcaggaagcagaagaaaaaaatatttagagaagaacaaggcaacaaggtctcagatacaaattgagaaagccagaaattggaaacgaggtggaaaataaggtcagggaaagtacatcaggtagaaaatgaaaagctaggacaaccgctgaatataggcacataagatagacgtcaaaaaaaaaaa

SEQ ID NO: 582 - DNA, 231 bp, dog
gttggtacttggacaggtatagtgaataaagctaattggtgagtggaatgaatacacagtttcataggacctagaaatcccttatcgtatgacttagggaaaataatttcattttgctaattttttcatttctaaattaaggaggttggaccatgtttttccaggtcctttttggctctaattatgtaatttgtgaattttctctgtgaccagattccccaaaaaaaaaaa

SEQ ID NO: 583 - DNA, 372 bp, dog
tcgaatctaaagcccaaggagatgtgacagtgccagggagcatccaaaacagcagaaaaccaagaaagaagtcactgttacacatgagactcataggaaactgctggatagagaggagggtgaccacaaaccctggtgcatacctgctgtctataattatcacaagcatcctttttcagtggcaaattatacagtgccactatggatagagaaaatgaagattttaaagcaggattcatttaagggagtaatggtagtgtgtgaatgagtggataattcagaatcattcctagtttgtataaaccacaaaacgaagctgcctataactataggaagaattcactgcattatcttgtggatacaaaaaaaaaa

SEQ ID NO: 584 - DNA, 215 bp, dog
ctagcattaaggccgacaaaggctattttgtgtttactgcttatttcatgtaggagtgtgtacattccggtgaaaatggctgttctctttattttcacccactgcttaaccatatgaaaaagcccattcatgataatgagttgtagtgactcagaaaccactcccactatgaaacggcttcatttttaatgttcttgaaggtccaaaaaaaaaaa

SEQ ID NO: 585 - DNA, 321 bp, dog
ctagcattagcaactaaaaacactcggattgtcttggctggtgaccacatgcagctcagtccttttgtttacagcgagtttgccagggagagaaaccttcatgtttcattacttgatcgactctatgagcattaccctgctgagtttccatgtagaattctcctatgtgagaactaccgctcccatgaagctatcatcaattacacctctgagctcttctatgagggcaaactgatggcaagtggaaaacaaccagcacacaaggatttctacccactaactttctttacagcacgaggggaagatgtacaaaaaaaaaaa

SEQ ID NO: 586 - DNA, 114 bp, dog
aactgaggagcagtggatgagtaagtggcttctggaaaatggtaccatatctcttgttttaagggcatcttatttacattaaataaagtttgaatgtcccctcaaaaaaaaaaa

SEQ ID NO: 587 - DNA, 154 bp, dog
aactgagccagctaggcatcctggtaaagcgttttgaaatcaggaaataggagtcctctatgttctttttcaaaactgtttttggctattcagagtcctcagagattccatatgaattttggagtagatttttctatttctgcaaaaaaaaaaa

SEQ ID NO: 588 - DNA, 163 bp, dog
aactgagcacacataggaaagtctagacactgtaagtgtgatatgcattccaatgtcatgaagttgccaattccatttttaaatgccacagatgcgtgttgctcccagtctgtggtcagagggtgccacggaactgatccttgacacttcccaaaaaaaaaaa

SEQ ID NO: 589 - DNA, 169 bp, dog
aactgagccctggtgaaatcaactacactggtgtaattggaatgatgtaatgaggggtgatggatggctcgccatccttgtggatagaaccattttatatgacatctattcaaatatcagatttttaaaatagttacacactcaacttttcctttcccaaaaaaaaaaa

SEQ ID NO: 590 - DNA, 170 bp, dog
aactgagtcacctgggggcccccaaaagttttatataatgggccacttattaaaagacacaaattaccaaaactcattacagaaggaatagataagaaagaataggtctgataaccctattaaagaaaataaatttgtagttaaaacctctccccccccaaaaaaaaaaa

SEQ ID NO: 591 - DNA, 143 bp, dog
gttggtagtgtaagtgaatatcacaaagcaggaatggaatttggcagagctgggttttcaaaataattactttacagtccaactgacatcttttttaatgcaatttccccctagtaaatttggggtggcggcaaaaaaaaaaa

SEQ ID NO: 592 - DNA, 197 bp, dog
gttggtagtagtagattctacaaaaaataaaaagacaaggggcgcctgggtggctcagtcatttgagcatccgacttggttttggctcaggtcacgatctcatggttttaagttcaagccccgggttgagctctgtgctcagcagagaatctacttgaggttctctctccctgtcactccttcccccaaaaaaaaaa

SEQ ID NO: 593 - DNA, 212 bp, dog
gttggtataaagcactgttcctcaaaggtacacttggggatcccaaaatatctttttcacctgttgctaaccagtctgggacttcctgtcttagacactgaactggagcaattctgaaagggaacaagaaaacaaacacacaatgaactgtagctattctacaaatgttttatattttttacttaagatggaagtttgtccaaaaaaaaaaa

SEQ ID NO: 594 - DNA, 300 bp, dog
gacctttatacatgctcagtctccataggcatgctatttctccaaggatgctttcccacttctcctcagcctcttgagattatggattaggtttcctgtccttcaaggtcatggtgaccttcatggctctcatctagattgtgattatatatttaacctgactctttgtttcacatccattaccctacttggattacaggttccctaaaagcaggaactatcctattgaatctgttgcagaatccccagtgtctggtatataggaggcacttaaaaatacttacttaccaaaaaaaaaaa

SEQ ID NO: 595 - DNA, 730 bp, dog
gacctttgaaatttgcatgtgacctcatctagctatgaattctgggaagtcaatgtgaaaaacattgctgcattcatgcaagactgaaatttattattagacaaattaatcataggaaaaaaaaaacaaaaaaaaacctgtggcaaaaacgtttctttcttattttttttttcttttcataaaacagacttgaaagtattatacagggattggcattcttcccggtcactggtaacaatagcaatatgtgtccagggacacagaatgttggtttctaacagactacttccaaaaacagtttgagaaaaaaaactgtctgattttaagtctctagaggtctgtaatagtttttacatttttcaggcagtgtaaagttttttgataaggccattttaggtggctcactttctcattaagatatatatatagaaccactttttgtagattagtataagaaaaaatatttaccctgttttggggcaaatgctacctatttgtgtcaccttttgctgaactgactcacagttagacaatccatggtttaatgcacatgaaattacctatattttatactgtttcaatgtacaggagaaaggttactgtaaactgtgttatgttggtgcttctgtgaattaagttgtggtttcaatcatgagtcttacggtcttaatgttctctgttgataagacaagtttagaattggtttacttaaagaatttcaaaaaaaaaa

SEQ ID NO: 596 - DNA, 214 bp, dog
cgaaatggaaaaacctttgccgcaagtccatctgggacgcccttttgatcagagtaaggaactaactggctgtccctccccgcggccccacgtcaccctggacacacctgcctgtcaccgtaggtctttataaacatacacacacatgaacacattgagacggattttttttaactgtatctctcacctttttaggaacatacaaaaaaaaaaa

SEQ ID NO: 597 - DNA, 228 bp, dog
tcgtacgtatgcgcagaaggcaggcgggcgggcccggggagcgcaggcgcccgatgggtctgagaccgtggagaggcccttaccttgtcgatattcagaggaagcacgtatctcctaacttcaggctgcggagcctttctggcattttttttcacctcttcccagttctcacgtaaattggctaaatacaagtaattgtagacgaattcaaatctgcaaaaaaaaaaa

SEQ ID NO: 598 - DNA, 413 bp, dog
cgaaatgacttaaagatgggaaaagggaaagtggctgcccagtgctctcatgctgctgtttctgcctacaagcaaattcaaaggagaaaccctgagttgctcaaacaatgggaatactgtggccagcccaaagtggtggtcaaagcccctgatgaagaaaccttggttgaattattgacccatgcgaaaatgctaggactgactgtaagtttaatccaagatgctggacgtactcagattgcaccaggctctagaactgtcttgggaattgggccaggaccagcagacctaattgacaaagtcactggtcacctaaaactttactaggaattttgtatgatagtcccaacatgatgtgcttggaaactgtaaattctaacaataaaagctgaatttcttcccaaaaaaaaaaa

SEQ ID NO: 599 - DNA, 174 bp, dog
tgagactgcaaatacacagtagaaacgcgcctgctgggatggaggggtgctttattttagggggctcgcattcattctttattggtaatttaattatcaccaccagtggaatattttttagactagatagaacatgtgatagggaagatcatgattttgtgccaaaaaaaaaaa

SEQ ID NO: 600 - DNA, 176 bp, dog
gcggtgacaaaggaagggataaggcacgaaagagtgagcctgtcagccagtcagtggctgcgcatcagacgagagggacgttaacacaaacaggcccctgaccttacagacctactgaggggagatgctgagaaggatctcacgtcacctctgaggtctcctgccaaaaaaaaaaa

SEQ ID NO: 601 - DNA, 198 bp, dog
gcggtgatgagcactgggtgttacatgtaaatgaggaaccactgaacccttcatctgaaaccaatatagaactgtgttgtttaactagaatttaaattttttaaaaaaagaaacattaaatgtgtagataatgaaaggatgtgaagtttgtagaaggaataggaaatgtttgccttgtgattcagccaaaaaaaaaaa

SEQ ID NO: 602 - DNA, 148 bp, dog
gccatgggatatgggaaatggggtgaatggcacccagcccacccctggaccgtcagatggctggggtcacgctccaccaggttgctgaccgcccttgaatttgctgtgactccaacaataaaggacccttcatttgcaaaaaaaaaaa

SEQ ID NO: 603 - DNA, 406 bp, dog
tgaattccagtggcgttaggtagaacatgaagagggatgatcacctcagtcggtcgaggaggtattatttgagcccccttccctctggcaaagtcaggattgaccccgaagtggttttgggagtattaggattttataagttctccctgacagttccaggtttagatgtttgaggtgttgagaaaaggtaaaaggaagtactgaactagtaagaatgcaaagtatttaggaaggtaatttgatcctagtgatgctgttacataaaaccaaagccttctgagtaatcttcactaggtatataggtcatttatctccgaagaacagggtgcaaaattaaactggtgctattgaacagtatcccctttcttcttttccttcacttcaagtaaatagtcaaaaaaaaaaa

SEQ ID NO: 604 - DNA, 131 bp, dog
tcaaagatcatcaatattcgcaacaatgggctaatccaaagatagtgccagttacttccctgagaaggaggagatgacatctatgaagatgctcttttccaacaaatttcaaatgctgccaaaaaaaaaaa

SEQ ID NO: 605 - DNA, 212 bp, dog
tcaaagaacgggaacaaaaagagattgaagccatgcattccctgagagcagccaacctagccaagatgacaatggtggaccgcatagaagaagtaaaattttgcatttgccgcaagacagccagtgggtttatgctacagtgtgagctctgcaaagactggttccataacagctgtgttccccttcctaaatcaggttcccaaaaaaaaaaa

SEQ ID NO: 606 - DNA, 246 bp, dog
tcaaagacctgagactatcacacttagcttcagtgttcttatatagttcaatggcccctgctgtttaatcttactgcacatggaaaaaaaaaagaagtgtgccagcttgaggaagcagtgtcttattgtcacagtaaatatactggtttatgctaaacttagtgagatgtaccatgtttgccaacaaattattcttagcaaaaataccaacacttgtgcatccatctaaagctccaaaaaaaaaaa

SEQ ID NO: 607 - DNA, 470 bp, dog
tcaaagaagtgggtgggggtctggcttaaccttatagttggaaatagaattaaaaagtaattgacttgcctcaactgtggaaagacaagtaaaataggtgtttatattatgaaattcaagttgacacaaaatagctgaaaggcttcaatttcagccaagttgaaatgatctcactttcctttatatttcattttatttactgagatacttgaaacatttccccctattgcctaaaagcaaatggaaaaggtgctaaatgcatggtagaaatgtgttgtcaaagcctccaggggctgtatcctcagtcttcagcacatattagtgtgattctgctattcttactacagatgattacagcaaactctgcaatgatgggtggagacacttggttggcttccaaagaaagtgactaataattgacctaatgtacagagcacatgaataacatattctttgggcaaaaaaaaaaa

SEQ ID NO: 608 - DNA, 583 bp, dog
tcaaagacacagggaatcacttataattatggtggaggaatcaatgcttaggagaattgcacttttgttcatatcactaccattgctttcctgttgcttgatagcatatgtatctttctctcattgtaagaaaattatggtaagaagattaagctcttaatgcattaataccaaaatgagctagctagatgatagtatggtggtactgatagtagagatgctaccacagaataggtcacataattgaatatatgttaatatcaatgcacatgcatatacctgcgtatatacttcatattaaattgcctgtgaatattgaaatcctccaatttgttgtatcctttaaatatcctaatgtaatagcagtttgcacataaaccaaatttgtgcatatttgagttgtatgtggctcttgggaaagttttaggaaattttctgaaatagcaattttgaactgactactcaatctgttcatagttcaggtacggttcagatttttttcctatgtatttgagaagctgaagtcagtcaatcaaaaatgatatgtttattaatgaactcttgttctgtgcaaaaaaaaaaa

SEQ ID NO: 609 - DNA, 112 bp, dog
gtagtaaatgtgagaagagagaaaggacttgaagagggaattattgaccgaaagaaactagaaattaaagacttggaaaattctcagcctatccactttgcaaaaaaaaaaa

SEQ ID NO: 610 - DNA, 263 bp, dog
gtagtaatagtaattgtatctgactgatttaattaagtacagtgcctaacaaaatagagttgttactactttttaagggacacatcttcagtatgatccatttatactttgcaaacatagcccttcattgctgtgaaggaggtctgagttagtagaattagagtttaatatatcagcaagaataagatgctaattattgttctttagcctaagggaatggtttggaaacttactaatattactctaatcatcaaaaaaaaaaa

SEQ ID NO: 611 - DNA, 301 bp, dog
tcatatggaaaggaaatggaaccagtatagttaagggaattctgagaaggaagaataaagtaggatatcagtctacccaatctcaacactttttatacagctatagtaatcaagtctgtgtggtgtcagaggaagaaaaacacacagatcaatagaactgaacagagaccccagaaatggacacacacaaatacagccaactgatttgtgacagaaatgcaaaagcaattccaaaaagaactaaaagtctttctaacaaattgtagtggaacaattagacatctatactccaaaaaaaaaa

SEQ ID NO: 612 - DNA, 406 bp, dog
tcatatgcagggagttggccctgatcattaaggaacctgtagataacagatacattgagagaggtaaagtaatcaggaagcagccattaaggcagcctgtgacgaggtgctaggacaggcgtcacctaacatgatgtcggtattcagacaagcgatacatgaaggctgaaacgtttgacagttttgtggtagaagtgagatgttgggtagagcctgagtcaggtctggaaaaattggtctttgggaaaggaactcatatgaagtgtggtctttgaactgggcagtatgagcatgctttttcacagcacttctgtcgtgatggtgatgcattcgtatgcctacgtcacagtgtaatgtcaagtccagattggtgaatgtcagaaaaccacccccccaaaaaaaaaaa

SEQ ID NO: 613 - DNA, 353 bp, dog
tcatatgaacacctcttctgtaccaatcatttggaaaagaagtgagcatatctcttgttttagagttttgcttgtctgtttagcattcctttttgagtctcaacatatatggaacaataaatgtcatttaatgctgtgtgctattttgaattcctcatcaggttttagaagtggggtcaagaacacttaaaagctcattgaacttgaaattataccaagcagcattgaacattagtctgtcccagcaaagcaggttaaattatggcaccagcaaatttgctattttttttaatagtaggatgtatacatttcagtataataaatgttttccgattgttttgcaaaaaaaaaaa

SEQ ID NO: 614 - DNA, 345 bp, dog
tcatatgtgcagggaactcttactctttctgtatacaattgatcggttttcacacttgaatagtcttcataatggtacttatgttcctgttcttaattctatactacatgtattatttaaaatactgaagattcaggaaatttgctttgtcttgttgtgtgatctgtaacagaggtctactgtgatcgtatgttatcctgaagaatatattttcttcttaatttttaaggttacctccaggagtcgctttgaacctaccaggcatagcttaggaagatgttacctgctctgctgatttatactaaaagggaagtttttagggaaggtagttgtcaaaaaaaaaaa

SEQ ID NO: 615 - DNA, 226 bp, dog
tcatatggtaatgaatggggatttgagttactgtgatgatcatttcacagtgtatacaaatattgaatcactatattgtacacctgaaactaatgtgttaaatgttaactagacctcaatttaaaaagagaccgggaaaaagaagagctgatatttcctataataggctttttgtgttctcatcaagataacaggcatgacagccaggatctatcaaaaaaaaaaa

SEQ ID NO: 616 - DNA, 211 bp, dog
tcatatgttatcaaattaatatgaatgggttgagtatcctctgaaaagacaggctaaaaaataaaacttgcctgttcacaaaaaaaatgtatctgaaacaaaatggtaaaatattcccttcctaacaaaagtgtgggcaaataacatatcaggcaaaagcaaactacatggaaacagaggagccatttgatttcaaggccaaaaaaaaaaa

SEQ ID NO: 617 - DNA, 142 bp, dog
tcatatggccatagagggtatcacagggtcattatgggcccaggctctgagggatgtgagtatattacctctggtttgttataaagatcaactgagttcaggtactttagtcaccagaaccaaaaacggtcaaaaaaaaaaa

SEQ ID NO: 618 - DNA, 124 bp, dog
tcatatgtagatttgatatcttagttaaattatcttcatatgtatacaattaacagagatgtgtggtactgaaggtctcctcacaactttttgccaactattgacacattctcaaaaaaaaaaa

SEQ ID NO: 619 - DNA, 299 bp, dog
aataacggagcatttatatttatggacaaggagactgagttagtggccaggtctgaatttcaactccagacctgtaggctttaattcttggtttcctgagggagccatgataatgaggtaatgattactttttccttgatcttaatcaactaaaaaccacagcagctttatattgtctttcccttttaagaagcagaccactaaagaaaaaaaaatttaagtcacgtttcactgtttgctttatatgttgttgggtttgtttgttttaagattatttatttatttgacaaaaaaaaaaa

SEQ ID NO: 620 - DNA, 209 bp, dog
aataacgtactagccattgttgcttagccttttatcaatgagtcattaggctaaaaatatttatgctttgtttagattttcctccttttgatgagttttcatcttgttctgagcacttctgaaggtgaacaagattagattcggtggtatctgtgagtttattatcagtgattattatcagtgaaattactgttaaccaaaaaaaaaaa

SEQ ID NO: 621 - DNA, 419 bp, dog
aataacgggaggggggtatatttgtgcagttgcacatttgagtaactattttctttctgttttcttttactctgcatacattttataagttcaaggtcagctgtcaaaaggataacctgtgggattagaacatatcacattgcaacaccctaaattgtttttaatacattagcaatctattgggtcaactgacatccattgtatatactaatgagtttctttcatgctattttgtttttgtttttgtttttgtttttgcattattatcaaatgcagggcccctttctgatctcaccatttcaccatgcatcttggaattcagtaagtgcataccctaacttgcccgtatcctaaattatctggttggttttcagcctagaatctgagacactttttagaaacatgcccaaaaaaaaaaa

SEQ ID NO: 622 - DNA, 436 bp, dog
aataacggtatgctgagagcctatttttatttccatatacatgtcttactgtttttatttctgcctgatacaccactatgtgtgtttatctaaccggtgtcatttattgatgaatgtgtggacttttccaattttttgatgttgtaaagaaatctgtaatgacattctgagtatatccatgcacatccattctttaagtcatgatttggcatactttttctataaaaagccagacagtaaatattttagactttgcaagtcagatagttacagtcacagctactcaactctgctgttctaacctgaaagcagctacagacaataattaaataatatggctgttttttagtaaaacttctttaaaaacagtccccaggttacagtttgctggcccttgatctaagtgattctttggtcagactaccaaaaaaaaaaa

SEQ ID NO: 623 - DNA, 507 bp, dog
aataacgtgaatgacaatctttgcaatattatcaatatttatttttcagtgggtttatctcatggacatcattaattgggaaaccagtattataggactttccatatgtatttttattaaacgcattttatgttctaattcccatttttctttcattgttctcatttacttttaaattgtcttctcttgcaaaaggccaccttaaatccttttaaagcaaattggtatatttgaataaaaggaaaattcagtattatccttttgaaatgtcaaaaaggaaatctattaggttacattaaaaaataatgctccagaaagtaaagtacatttctagacagttaatgcccttttcctgtggtttttataattaaacttgtagctagttgttttttaatatctgagacccaaataaatcatggcacataactataccagtatgactttgtgtgtgctatggaccagacctgccataatttcttaaaaatggcatttcaccaaaaaaaaaaa

SEQ ID NO: 624 - DNA, 123 bp, dog
ctttggtgaatgataagtaaaggcagaaaagattatgtttcatacctccattggggaaaaaagcataaccctgagatccttaactactgatgaacgcattatctgcatatgcaaaaaaaaaaa

SEQ ID NO: 625 - DNA, 126 bp, dog
ctttggtgaatgatgataagtaaaggcagaaaagattatgtttcatacctccattggggaaaaaagcataaccctgagatccttaactactgatgaacgcattatctgcatatgcaaaaaaaaaaa

SEQ ID NO: 626 - DNA, 353 bp, dog
ctttggtccataacctttcttgttttgaagacttccacttgggactacatctcagttatagaatttttaacgttggactgacttgatttaagttcttttatttctacagtaagggattctctagtttgcttctgtgctcttttaccagcccagctgctatctttataatcattgctttaaactgtagttagacatcatatatgtttattgatgaacttcctggctgtgagtactacttcatgttattttatggaggagaatttctcaatctcattattttttccaaaaaagaaagaagaaagaaaaggaaaaatcaagaaaaacaataacaactgccctcccaaaaaaaaaaa

SEQ ID NO: 627 - DNA, 174 bp, dog
ctttggtcaagtcttttatctccgttttcctcattggtaaagttagaatttgagacttgggcagatttttaaggttccctgtgtatgactcgatacatttagatgcgtttcataagagagcttgccaacttaaaccttcctgccaccagactatcatgtgaccaaaaaaaaaaa

SEQ ID NO: 628 - DNA, 126 bp, dog
tatttatccaaattagtatgattattcctgtgttgcactgcagaaatattaatgtttttgattataggatgcagcaagtacagaccatgaagcaatcatttattttaagacaagcaaaaaaaaaaa

SEQ ID NO: 629 - DNA, 148 bp, dog
tatttatggcacaaattaaattcaactaggaagtttttaggcaaatgacaaaaaccaaccaaacaaaaccccctagcagcagcagcagcatctttgctttttgtatttttctctgtgtataacatattattagggacaaaaaaaaaaa

SEQ ID NO: 630 - DNA, 289 bp, dog
tatttatcaagcattgtaattatgttgttccattgcattatatatgttcggtttccccacacccattgggtgaaattcaaacttcatagcctggcattcaacaatctttgcaaaatggcccctgtcactctttctaatcctttctgtagccatccttctttgtgactcacatgccctcatcgtgctagaactactagccatttcctgaagtgcacaaactttcgtttttccatttctttgcttttgctatttcttcgccgggaatgccatttccaaccaaaaaaaaaaa

SEQ ID NO: 631 - DNA, 418 bp, dog
tatttatccatgagagccacagagagaaagatgcagagacataggcagagggagaagcaggctccatgcagggagcccaacatgggacttgatcctgggtctccaggatcacaccccagggtgaaggcatcactaaaccgctgggccaccagggctgccctgttggtttttttttttttttttaagagactttatttgtaagtaatctttgcagccaatgtggggcttgaattctcaatcctgagatagtcacccactatcctaactgagccagctaggcatcctggtaaagcgttttgaaatcaggaaataggagtcctctatgttctttttcaaaactgtttttggctattcagagtcctcagagattccatatgaattttggagtagatttttcgtatttctgcaaaaaaaaaaa

SEQ ID NO: 632 - DNA, 234 bp, dog
tatttatgacgactttatttattctaatggattttatagtatttatatatattgggtcgtctgcttcccttgtatttttcttcctcctttttgtaatattggaaacgatggaataattattgttataagtatgctataataatatattaagtaatatattgttaaaagtttatttttgtggtttttggaatttttaaataaaaggaatctgtgtgtaaactgcaaaaaaaaaaa

SEQ ID NO: 633 - DNA, 120 bp, dog
gcctttagaatattaaacattctatcattgaagagttttggatgtataataattttgtgatgctttagaaaaatagtctaagcacaaaataaacttttctaagcacttcaaaaaaaaaaa

SEQ ID NO: 634 - DNA, 129 bp, dog
gcctttactatggagtcccggaaagagagggaggagaatgctgtagggctcttgcactgctttactgatcaactagctctacaagggccagaacatatagctgcccatatgaccccccaaaaaaaaaaa

SEQ ID NO: 635 - DNA, 146 bp, dog
gcctttatgtaaagcaaaattgttcccgttcctgctttgtttttactgtagtcatatttttaactggctaattttgaaatcagctttcatttaatatgtgtgttgttcagtcattaaaagcgtatttaattggtcaaaaaaaaaaa

SEQ ID NO: 636 - DNA, 199 bp, dog
gcctttatgcgttcggtggtataaagtgtcagtctttgtgatgtgaaaccagatcccagccttcattttttctttttctttttttctttttttcttttttttcagccttcattttaaagaggaatagtatcacctatgtgttagtttcctcttgctgctataacaaattgaccacagagctagtaatcaaaaaaaaaaa

SEQ ID NO: 637 - DNA, 214 bp, dog
caagacccagagtgattacataggatctgttttaatttaatcactgatttaacctataagcaagcttaatgtcatgggttcattagtgagagtgaagtactctctaaaaataatgtcttctttcttcattaggatccccatgatgttgtccaaggtaaagaaaggcaactgttattttatttcaattgatgctcaatttccccaaaaaaaaaaa

SEQ ID NO: 638 - DNA, 182 bp, dog
ctagcatgtagtaggttttcaaatagtgtgtaggcaactgttcatttcattccctctgcctgagttcttcattcagcccccactttagcccactctggattttggtgaaaccttagctgttctgaaaggattggctcaaaaatgccatcttctttcttggttgctccacccaaaaaaaaaaa

SEQ ID NO: 639 - DNA, 525 bp, dog
cctctatatggatggggctaagaaaagtagtgctgggaggaaaaggccatggtattagcacaatttagagaaagatgagaatctaaattgcttgatatttagtttcccgccaatgaatattgcaatgttatgctacccagcatctggatagtcacctaactattatcccgtattaggtaactcgtggagtcagggagtctgtttctaaatccatgcagtgggtgagttactgggttggtggctgtgggcatgttagtgacgcagcacagccagggacaatgttagcgctgccccattctgcaccctccatgaacctagagaactcacggctgctgtctgcctttgggtgatgagtcacctggctattttccttttcaattttcttgtcagactcattgaaaccttttatcatgaattatctaaattacagtttccatttctcaaatgagtgttcaggcaagccttcctcatcttgcgttccttttactcatcaccatttccactgtaatactgcaaaaaaaaaaa

SEQ ID NO: 640 - DNA, 415 bp, dog
cctctatacagccgactagttatgatcagagcagttactctcagcagaacacctatgggcagccgagcagctatggacagcagagtagctatggtcaacaaagcagctatgggcagcagccgcccactagttatcccccccaaactggatcctacagccaggctccaagtcaatatagccaacagagcagcagctacgggcagcagagtgagttgctaagagagaaaaccaaataagaatgattatgtttggagtttctgaacatggggaaatgctctttgtcgctatttacttttggactccaggatgcatctttaggacataacatcctagctaactgcttggatatcccattaaagacataaatgcttttctccaatttaattgttgttagtgtactttgcaaaaaaaaaaa

SEQ ID NO: 641 - DNA, 315 bp, dog
cctctatacaggtttctttactattaaaaagagtgacagtccataaaaaaaaggcgaggggaagaatgtggctctcacactgagtcactgcttacgtgtgaccgggccctcctgttctcggtgtgacctcacggtcacagaattgtggaaccagaaggaactagaagtgacttatctgaaatcacacaggtgttttcaaaagcccaagagtagaggggcacctggggggctcagtaggttgagcatctggctcttgatctcagctcaggtcttgaagtcacagttgtgaattcgaggtccatgcaaaaaaaaaaa

SEQ ID NO: 642 - DNA, 298 bp, dog
cctctattgttagcatggtggacaggaagagactatgtctcgcaggtctatcaatggtgttaatttttgctttgctttgtcactcagccatttacctaagtggcttcacccttttaggtgaagagacaatttttcttctcaagcagccaaacagtcttaataagtcagagaacagcatggaattgccataagcatgaatgaagagcaatagttcttttagtcgaggcagatggaaatgttttcatttcttatactctgtgacgtttgtgagaagttcagatatttccaaaaaaaaaaa

SEQ ID NO: 643 - DNA, 254 bp, dog
cctctatcattaacaccttgtccctgtgaatgaacatatgtcactgcgaataaactagtgtcgacacgtcattatgaactgatggccacggttcttcaatgattttttaaatcattctccgtagggtcccactccttgaagcagaaatacgcaagttgggtagggaattctgtactttgctttaaatttgaaataataaaattcctgtcctgtctcttcacaaaattataggatgatcctttcaaaaaaaaaaa

SEQ ID NO: 644 - DNA, 192 bp, dog
cctctatttagcccctcttggaaattcaccaccaagcttggggacttcaccccacaaaattgtaagcgttgttaggttttcgtgtcagacttgctgtagcgtggagagttgtgattggtgagccagccatctgtggcttccagttacaccgagactgtaacagcatttttactttctgtacaaaaaaaaaaa

SEQ ID NO: 645 - DNA, 154 bp, dog
cctctattccacatggtactgaaggttctaactaggataattaggaaaaagaagtaaaaggatccagattggaaaggaagaaataaaaatatatttccagttgactttatcttatatatagaaaatcctaaggaatctagaccaaaaaaaaaaa

SEQ ID NO: 646 - DNA, 137 bp, dog
cctctatactcctctgttttgtttcttaaattccacatactgagtgaaataatatgatacttgtctttctctgtcagtcagctactttgaaactggtttgggaaaagttgcttaaacctcaactccaaaaaaaaaaa

SEQ ID NO: 647 - DNA, 516 bp, dog
ttgaggtgacagagaaaggtataagcaaaactggaagagcatttagcaacaattttcgtttcaggtctatgttttgagaaggccattcccagatattgtgtggatgaagaatacgtagaggaccccgacctggacctacaactgtgtatgagttcatcttcaagctaaaatagcccagatatctcagaaaagacacagtgcgactagatactcctagaattgcttgctcaaacctacactatgcataacttttgactttccagttataccaataaagcatcatcatttttgaagaaatacccagagtcttaaaagaccccagatattgttgctgccgtctctgaactccagtggatagggaaaaatgtagaacagattcccttatgggaagtttaaatcctaaggcaatgtagccaagtcattcttattattcatgaaatcaacctgtttcagggaacaaagctttccaatgcaattttcaaataacacactcaaacaggtatgcaaaaaaaaaaa

SEQ ID NO: 648 - DNA, 398 bp, dog
ttgaggtggatctgcttttattcttggcaaaagttcagcggagaccaaccagagtggtgacaaagttcttcaacatcaagccaaatgtaatacaaggaattacggatagtgcttaatctaaaataaagaaattccacatctccctaaaaagttattggcttcaagaatgaaaacaaaagaagcatatttgtctcaatccaaacacagacaccagaaagacaaaccaggagtatacagcaaagtagcttgcaggataatacattgaaaaatgtaattgtgcataaatcatgcacaaagtagaaaccacaaattctgtatttggcaaggcttcggttcctttgcataattctttcattttcatcttgctgcttccattctcttttcatcaaaaaaaaaaa

SEQ ID NO: 649 - DNA, 362 bp, dog
ttgaggtgataggtagctttgaaaaaaagtagaactcttatttaaaaaatatatagtcgttaaagttaacaattcatgattcatttaaacaccacattagacataggtaaagaaagaattaatgaactagaatgtatatctaaagaagccacccaaatctagaaacagagagagacaaagaggtagtaacataaatgtagccatgacagacatgagatgagagacagaacacatgccaggacaggtcctgtttatttgcttatatagtttccattctgtctttactcacaaatttctgacttgtttggaatgacagtatgtccagctaagaaattatctcccagcacacccaaaaaaaaaaa

SEQ ID NO: 650 - DNA, 335 bp, dog
ttgaggtagctaagaaaaattttagcatctttgtacatgaagagtttttaaaatactaatcaatgaaaactaaatatcaagatacgtttcttacatgttgcttagaacatgtttgtcagcaatgggcgaattttccaaataggtaatttatgttataatgtcaggattttgttctctaatgtaacattcgatttataataacttccattaaaaaaatgatagtctagtggcagaatcattctggcttttcagactctcatttgttggcaatatgtatgatatttcctttgaaaaattgcagagtagtgacccattatagaaggcaaaaaaaaaaa

SEQ ID NO: 651 - DNA, 332 bp, dog
ttgaggtacatgctagaaatatggacttaaaggcatttctggtgaagtgttaggaatgcgaatctatttttggaaactggagaaaaggtgattattgctataaagtggcacttggccaaaccattttctaaagttttgtggaaagtagaacttgagagtaatgaaattggatatagaggtgaggatatttctaagcaagtgtttgaaagaacagcttgattcctcctgactgcttgtatgaaaggagagatgaattgaagaaggaattgataaataaaaatggaccagaacttgaaggtttggaaaattttctgtattaccaaaaaaaaaaa

SEQ ID NO: 652 - DNA, 284 bp, dog
ttgaggtttgtagttttttctgtacctattgggtaaaacctattggttttactgctgtgaaaacatgtacctttttgtaattaaaattgactaaaaaaagaacatatcgttttttagcttcattgcttttgctgccactttgccaaatggtaacagcgcaatgtattttcgtttcggtaacaggtccccgatgtgcgacagatggaaatgtaacaggtactttcagtagaagtccatttgtagtggagtggcggtataataatactgttgttcaaaaaaaaaaa

SEQ ID NO: 653 - DNA, 231 bp, dog
ttgaggtcaggagtttgagagcaggctggccaacatggtgaaaccccatctctactaaaaatacaaaaattagctgggcatggtggcacacacctgtagtcccagctactccggaggctgaggcaggagaatcgcttgaacccaagaggcagaggttgcaatgagccgagatcacaccattgcactccagcctgggcgacaagagtgaaactccatctccaaaaaaaaaaa

SEQ ID NO: 654 - DNA, 700 bp, dog
gcaagttggatgcgatcaaagtattctgcaacatggaaaccggggagacgtgcctgaatgccagtcccgggagcgttccccggaagaactggtggacagattctggtgctgagaagaaacatgtttggtttggagaatccatggatggtggcttccagtttggctacggcaatcccgagctgcctgaagacgtcctcgatgtccagctggcattcctccgccttctctccagccgggcctcccagaacatcacgtatcactgcaagaatagcatcgcgtacatggatcacgccagtgggaatgtaaagaaagccctgaggctgatggggtcaaatgaaggtgaattcaaggctgaaggaaacagcaaattcacatacacagtcctggaggatggttgcactaaacacactggggaatggggcaaaacagtcttcgaataccgaacacgcaaggctgtgagactacctattatagatattgcaccctatgatgttggtggtcctgatcaagaatttggtgtggacgttggccctgtttgctttttataaaccaaactctatctgaaaccccagcaaaaaatttcacactccatatgtgttcctctcgttctaaccttgtcaaccagtacaagtgaccaactcaattccagttatttatttccaaaagttttggaaaaaagtataatttggcaaaaaaaaaa

SEQ ID NO: 655 - DNA, 507 bp, dog
gcaagttgcagagttcctgggtggcagggctgtttttttttaaacaggttttctggttcctatctatgttttgtgaagaagacagcagttataatattcctttgttctctctacactttgaggcaaggaacttttccacttgagttctgatataaatgatgaagagaaccaagtaagagcattatttcttctagattcttccatacaccagggccctaccaccaaataaattctaatttgaggaaatacaaaattaatcttttcctttagcacagggaaaagatttagcactttcccttggcacaggaccctggtacaacagaattcctgcccggttccaagttctaaatgagaatactttgggaactcctatgagagtctcacatttgcagcaaccccacgactgccctgcattctctggacagattccagcagaatttgtgtttcttgataaccttattggtcttattttgaaaacgagtcaaatatctcatgcaaaaaaaaaaa

SEQ ID NO: 656 - DNA, 476 bp, dog
gcaagttccaaagataaagagaaaaccctcaaagctacaagaggcaagagattcttaacttatatggggagaaatatcagattaacagcagacttctctacagagacctggcagcctataaagtgctggtatgatattttcagggaactaaatgagaaaaacatgcagccaagaatactttatccatcacgcctgtcgttcagaatagaaggagagataaagagcttccaagataggcagaaactgaaagaatgtgtgaccaccaatccagctctacaagaaagattaagggagatcctgtagaagaaagaattaaagacctaaatgtgagatgcgaaaacataaaaaatcctagaggagaatataggcagtaacctctttgacgtaggctatagcagtttctttctagatctatctcctgaggcaagagaaatgaaagcaaaaataaactatttagattatatcaaaaaaaaaaa

SEQ ID NO: 657 - DNA, 468 bp, dog
gcaagttcatctaccttaataaagcacagttttcttcctgcctttaacaatgtgttttgtaaaatctgggaatagaagagaaagttactgtgaaatatagaatcaagaaatatgagacaatgcacactgaatatctgcatatatgactggttactaggtaaaccagaatgtaaccaatgttggtgttaattgtattaataattatgaaaacatcactcgttgaaatgtatgcaagaatatattgagcacagaagagagcatgttggataattctatttatattgcaccccgagaatagaactcatctgcaatcacagaaatcaaaacagtggtggactgtggaaggtggaggtagaccgggaaattgactgggacattctggagtgacagaaatggtctttatcttgatcaggatacttggacaaaatacatctaaatgcacacttaagatttgtgcaaaaaaaaaaa

SEQ ID NO: 658 - DNA, 422 bp, dog
gcaagtttaaaatatttgctatctagcccattaagaaaaagcttgttgaccactgttttggtgagtgattctcaaaaaagagtggtcctcagactttagcaatacctgggaacttgttagaaatgtaaattcttgggcggactccagaaattcttgggactgggaccaataatctgtgatttaagaagccttctacatgactccgatgcacaataaaaatttgagaaactctgttctagataagtgtttctcaagtgttagccacacatatactgcctttttgccctgttgtctaatattttcttcacgtcaactcactttctaaaaatttaagttaattttaaaatgaaaatttatgtcaccagaaagatatagtgagaacatgatattttgaaaaataacttaagactcaaaaaaaaaaa

SEQ ID NO: 659 - DNA, 223 bp, dog
gcaagttacaatgtgttactaagccacaaaatcacttttggagttgatgggtggggtacagttagcattcttgttttcatgaaatagaatggaacctaagtgaaaatatagaaatgtagcatccctgagaatatcatttcattgaatttagtttcaaatatgtgtatattaaaccgttgtgtaaaatctatttcctgctggaggtctaggtcaaaaaaaaaaa

SEQ ID NO: 660 - DNA, 194 bp, dog
gcaagttgaagacatagagacctaggaatgattttagattgagtattggtcccaagcctgaggagctttagccaaggtagccttggatcccttaaaggaattaagctccttaaataaagcctagatattggaagtgtatcccctccatcagataagaactcaaaaaactcttcccattagcccaaaaaaaaaaa

SEQ ID NO: 661 - DNA, 319 bp, dog
ttatccgaggaatctacagagtgagagtatctggttatcaggtttggcagcagagtgaaaagagctagaggcactgagaatagccagcattcccatggtttagaggagaaatgatgcagccaacatgggaaaaagaatcaagagtcattttaaaagggtccccacccaatatggcttgctgctcccttgcaatctaggcagaacaatgcagtgaaatggtgatggggtgggggattgaaaacaatcagctaaaagaatgacctcctctgtcagggggagctgttcctagttgatagaaaccattctccaaaaaaaaaaa

SEQ ID NO: 662 - DNA, 213 bp, dog
ttatccggcatcatttaaataggaaaaaattagtgttggcaaaacacaaaaacaaatacggcatgacatgaaaatacaatcttatgtttacaccggcttttcactaacatgtacctaagaagatggagaaatccattcagataatgaaattctgtttcatctagggaagttaacaggaataaatgtatggacccccccccccaaaaaaaaaaa

SEQ ID NO: 663 - DNA, 169 bp, dog
ttatccgtggccttgcgcacagtataggctaatgtacatgataggaagaggagataaaattctgtgatgctctggataagatccctgtgacataataggaagacctcagtggtcttgtctacattttgctcattatgcaagtgataattagatagatcaaaaaaaaaaa

SEQ ID NO: 664 - DNA, 110 bp, dog
ttatccgaagattagaacaaaacaaaaggattgaaaataacaaatattttttttcttattgattgtggaaataaacacctccccctacccatcaaccccaaaaaaaaaaa

SEQ ID NO: 665 - DNA, 106 bp, dog
ttatccggtgaggtgagtttagatggtatgtttgtggacctgtgttcacagttatgtagtcattttaaatatgtattagaaaagctagcacacacaaaaaaaaaaa

SEQ ID NO: 666 - DNA, 99 bp, dog
ttatccgtggaatgttttctgctttcttttcttctcccagctcccagtttagcattcattgactgaatagaggctttgagggtggcacaaaaaaaaaaa

SEQ ID NO: 667 - DNA, 620 bp, dog
catatgccaaccttgaggtcccaatattacagatgttaaaatgtctaaaagtgtagtaaatgctcagccctttaaaaagaattaggaaagtatccttagaaaattcattctgaccattgcaaattattgttataccaaggtaaactagttaaaaaatatacacttatgcaattaaagtattaatctaaaattctcaattatctatctatgtacagaaaagagaatagatttcctcttcaaaaccactgaaaagtattaatttgctgtgtgaactttgggagttttttttttaactttgggagttttattttatagtcagttacaaaaggaaggaaaacaaaactgcccccccccaattaatcccttcccatttgcttatccacatagatctgataaatactagcagtctcttgcctttgaagacggccagaccagaatccctacttattgccagatgtagtttaatcccatggggactccagacaaaaacaaggagctgtcttcatggcaccaatgattatctgaactgaatgccataaatttatatttgcaaatcaaaatccttggcaaaatagaacatttattatatcaccacttccaagactatccaaaaaaaaaaa

SEQ ID NO: 668 - DNA, 279 bp, dog
catatgcagtaatgggggacctcctctgacctcttctccagccatttgaaaaatatgttgtagggtgagttgggccatctctgtgaaccctgacctcatccccacctcagcaaccatgactgaagcctcagtgtgaacttgggggactttctggtggacccccagtgcccaccagccccagccattttctgccaatttgattgtttaaaaaaacaaacaaacaaacaaaaaacgataaagcagggaaaattaaagacctggaacccccaaaaaaaaaaa

SEQ ID NO: 669 - DNA, 270 bp, dog
catatgcgccagtccagtggaggttttgggatgtcctacaatcaaaacccttgcctaatccaatatttcccaacatctgtctcaccatttgtccggtgttaatagggcagtgttactctttgcttttctgttttgccaagttttattgagatggtaacatgaacaccatgtaagtttaaggataacagcacgatgatttaacttacatcttttgtgaaatgatcatcacagtaagtttagttaacatctgtcatctctcaaaaaaaaaaa

SEQ ID NO: 670 - DNA, 186 bp, dog
gtagtaagcgaacagatctatgtgaccatgccctgcacatatcgcatgatgagctatgaaccactggagcggcccagactggcaggcttgatggatcacccccaggaggggaagagggtggcaatgccttttatattatgtttctactgaaatgaactgaaaaattgtgaaacccaaaaaaaaaaa

SEQ ID NO: 671 - DNA, 159 bp, dog
gtagtaagcaaccagaaactacacaaatatccaacaaaaagaaattcagttgcagtttgtatagttacatacaaaaataattattgtcataagtcatattttgaacagtcatgtggaaaacttctcgtattgagtgaagaaagggtacaaaaaaaaaaa

SEQ ID NO: 672 - DNA, 259 bp, dog
tcaaagagacaagaacgtcagataagcatgattcagttcgaggttcctcaactaaagactttacccccaacagagacaaaaaaactgactacgacaacagagagtactcaagttccaaacgtagagatgaaaggaatgaattaacaagaaggaaagactctcctcctcgaagtaaagattctgcatctggacagaaaactaagccaagagaggagagagatttgcccaaaaaaggaacaggagattccaaaaaaaaaaa

SEQ ID NO: 673 - DNA, 176 bp, dog
catatgctgtatgtaagggtgtgggtatgtgtgaaggggtgagtgtagacactctgtttgtgtgtatctatataggaagatatacgccacattgaaaatactcagtgtatatctctatgtgtataggtatatgtccatgtatctctttccttttgtttacagttcaaaaaaaaaaa

SEQ ID NO: 674 - DNA, 137 bp, dog
catatgcaacatacaaataagaggtttttcttataaaaataactgcttaccagttacttttcataatatgtcctataagccttaagaagtagaatactgtcctacaatgacatgactgtacattacaaaaaaaaaaa

SEQ ID NO: 675 - DNA, 112 bp, dog
tgaattctaagagattgtgtagacactggagaaggaaaaggtaagattccccttgggcactttgtgaatgttacagaagtattactgttaaccataaatgcaaaaaaaaaaa

SEQ ID NO: 676 - DNA, 108 bp, dog
tgaattcctaaggctttagagggagatcccgattttcaattatgttggctttttataaagcttgagttatgtaagatttcaataaaaatttgctaccaaaaaaaaaaa

SEQ ID NO: 677 - DNA, 310 bp, dog
tgaattcctagtaaagtttccttaatttccccctgccttatttccatatctataaactacagataataacttccttgttaggttgttatggacggtgatagaggtaaatctcctgcagtccttagcacaatacttggcttataggaaccacttgagaaatattaactctcattcattgctattcaagggaaaattggatttcaattgtatcccgtcttctggaaggagaggaaaaaatgttatagaactaagaaagcaaagctgaatagagaaaactttttcatttaaaacgcagatacaaaaaaaaaaa

SEQ ID NO: 678 - DNA, 217 bp, dog
tgaattccaaaagataaagtataaaaagatattatttgcaaagcaatgcaaaaataaattttcattcatttgttttctcaaggtctggaatgttttgatagttttattgattttaatgttttgatagtgttattcagtaaatataaaaatatttactgaaaatatttttagtgggaagagttgctttgtaagagctgatacttaacaaaaaaaaaaa

SEQ ID NO: 679 - DNA, 378 bp, dog
aaatcgatcaaaataatattatttacttttctatctttaatgaataccgccttctttaaacaattccagaatgcttcttcccttttgcttttagaggaaaaactcctcaaaccagatggttgatcttaattaattcttatcgcagagacatctttgtcataaagtatttttcacagatgaacaggattatataagcgcctctgtttactgaattactaaaagaatgacttttcatgagggaagcagtcactgtaattttatcttttatttcttcaacttccttggcacttaaaagcaattataacatttaggctagtgagtcttcactgaagcaagagacgtatttattttaaatgcttatgttttcaaaaaaaaaaa

SEQ ID NO: 680 - DNA, 127 bp, dog
aaatcgaccctatccaatatttggtggaggaaatagaactattcaaggggtatggttttttaaagttccaccaccctattctagtcattgtagaatatttgaatgcccccccccccaaaaaaaaaaa

SEQ ID NO: 681 - DNA, 335 bp, dog
gtctaaacagggatattgtagcaattcttccataggcaactatttggaggcaagtttgttaatttgtacattgtataaatgtcatgaactttacttgattgcatctgactgtgttttggaaaattcaggaaatgaaactgtatttaagtcattattgcaaattgcaataaaattgtaaatacgttaccagagtacaacttgttgcacaacagaagtcactggaagtgttgctaagcaacctcaacaagcatgagttaaattaccaataaatatttctagatcttgtttacttgtttatcaagtagaactaatttcttacagcacaaaaaaaaaaa

SEQ ID NO: 682 - DNA, 373 bp, dog
agtaggcaatcactagacatcactttggggccctttaagtgaccattaggaaggtgatcacaatataatcacattgatagaatgttgtatcttagaagtcatcatgcttttgttctctttgctcaaatattgtcatatgaatgttcctctcaggaacagggttctagcagacttaatttgggaaaacaaattgaaaactaaatcttgcccttgttgaggtgtagggattaatcctcccctgaatatcaaagactaaagaatgctcatgaaagagaaagactttgtaataccacatcattgattattggcattactactttaaaagttggacagtaattctagagaatgaaaacaaagttcttaaaaaaaaaaa

SEQ ID NO: 683 - DNA, 356 bp, dog
agtaggcttggaggctgcctgaggaaatcatggaaactgctatggatgggaatcctttattaacttaatgagcataatagataaactccatatgtaccaatcctgcggcatagaccagcaggggagtaaacttaccaatattttaactttactttagtcaagtcatatacttcaatcaccttgaaaaaaaaaaatcaaaggtttaagcgctgtaatactctgcaattgaaaaagattgactaaaaagacacttataaagggatgcctggctggctaagtcggtagagcatgtgaatcttgatctcagggttgtgagtttgagccctttgatgggttatatcacttaaaaaaaaaaa

SEQ ID NO: 684 - DNA, 320 bp, dog
agtaggctgaagaaaataccgacctggagctcaggatggtcagagccagatatatagaaattggagtgatgactataaagatgaggatttgttctgtggtagtggatgagattttctagagtgtaaaatgaaaggaaatacctcaagtgcaaacacacttaaggagtttatccagctaacaaagtaattaaataataaacagagtggctgtagaatccctggaagtacagttggaatggatttgtttgttttcaaatggagtggagagaaatctacagggccagatgttaccaagaaaatcagtgtgattaaaaaaaaaa

SEQ ID NO: 685 - DNA, 270 bp, dog
agtaggctcaaggaaggacaatggcttaatttcagcaaataatagcaacacaagaaatcatgtgtgcaaagttggtcatcaaatggagcaaaagagggatccctgggtggcgcagcggtttggcgcctgcctttggcccagggaacgatcctgaagacccgggatcgaatcccacgtcgggctcccggtgcatggagcctgcttctccctctgcctatgtctctgcctctctctctctctctctctctctgtgactatcataaaaaaaaa

SEQ ID NO: 686 - DNA, 242 bp, dog
agtaggcatgttgtatgcatattagcaattttctgttatttatcctgtgttttttccttatctattttacagtgtttaccaacagctcagataataaattatggcataaatatgtagatgatacaaatgtatgtacatacattttatcataacagttttgtcatagtgagctttaaacagctacaatattttcctataaccattattacttaaatatagaaattctgtgtgtaaaaaaaaaa

SEQ ID NO: 687 - DNA, 139 bp, dog
agtaggctaataccgaacctataaaattaaagcactatgttatttatcaagtggttttagttctcaatagtgaaaatatttttgtacaaatcagaatatttccttgagaaataatcctttgtatctgtaaaaaaaaaaa

SEQ ID NO: 688 - DNA, 139 bp, dog
agtaggcatgaaaacattaatctcattgcccctctcctagacaagtagtgagcaactgccattggaatgatggtgccaaaggacttaattttgttgcagggttgtcacaaaccttcactctgttttttaaaaaaaaaaa

SEQ ID NO: 689 - DNA, 274 bp, dog
agtaggcacatgggtaagaatgaatgatgatatttcaagccaattggaaaagatacatgtttcataataaaaacaagaagcaaggggatccctgggtggctcagcggtttagtacctgcctttgacccagggcatgatcctggggtgggtcccgggattgagtcccacgttaggctccctgcatggagcctgcttctccctctgcctgtgtctctgcctctctctctctgtgtctctcatgaataaataaatttttaaaatctaaaaaaaaaaa

SEQ ID NO: 690 - DNA, 213 bp, dog
agtaggccagggaaagaaatatgaagcataaaactggaaaagattcaaaattatcattttgaattattgtcacttcccaaaaattatagagcatatctagaaaccacatgaaagctagctgaacacaattaagaactaaaaagaacccagtaaagtggttgattataaaatcaacatataaaattcaatagctcaccactgtaaaaaaaaaaa

SEQ ID NO: 691 - DNA, 79 bp, dog
agtaggcaggaagaacacttgatacatctatgcagattttataaatgtgcaataaaagtatttgttgtaaaaaaaaaaa

SEQ ID NO: 692 - DNA, 166 bp, dog
agtaggccagtatcacaggggaaatgtgaagaactagtaaccaatgagagacagcaatattggaaagcaccgcttttaaagcaaacagttatgaatccatatgcagaacagaatggtacagaatgaaaacaattgcaggttttgataggtacgttaaaaaaaaaaa

SEQ ID NO: 693 - DNA, 153 bp, dog
agtaggcatgtgagttaatatatttttaataagtctttttttaaacttcccttttacatgtgttgatgtttcattattggagaagggttgatgtaactgcaataaaattctagatcatgccattacttgatacatcctatttaaaaaaaaaaa

SEQ ID NO: 694 - DNA, 136 bp, dog
agtaggccagccctgggaacattctatcatccacctgtaagaaatgcacttctgccttccaattctccctgcccttctagtgaaaacatgcttgatgtgcttatattagatctgctctgaaacctaaaaaaaaaaa

SEQ ID NO: 695 - DNA, 124 bp, dog
agtaggcccaagtgattcttttcattcttgaaaaaggttagttagatattggtaggagctatttgtagtctggctgcaaaagtttttatccagcatcagaatcccaagtggttaaaaaaaaaaa

SEQ ID NO: 696 - DNA, 110 bp, dog
agtaggcatttatgaacataaggaacttcagtgtttcatttcttccaaaacatgtatgtttttgaattctaaagtaagaacttagcatgttgtttttttaaaaaaaaaaa

SEQ ID NO: 697 - DNA, 253 bp, dog
gcaccattaaagtacattagggagttgaatatggcaactaaagttcatttggaagaggaagaaagaggagatgcatagaaaactattactttttaggccaatagaaagaaggagttcaatccaagagatctattgtagagatagaacagttcattcattaagtagttgccaaatgtctactatgtagtcatgatgatgcacctagaggaagtattaaaaaatgaatcacaaacacttgctgtaaaaaaaaaaa

SEQ ID NO: 698 - DNA, 246 bp, dog
gcaccatcaaaggttttgtttccaattatttaaacggtgaacagaaagttgtgttaagtctcccaactttggggatcccttggtggcgcagtggtttagcgcctgcctttggcccagggagcaatcctggagacccgggatcgaatcccgcgtcgggctcccagtgcatggagcctgcttctccctctgcctgtgtctctgcctctctctttctctctctttctctctctatcataaaaaaaaaaa

SEQ ID NO: 699 - DNA, 150 bp, dog
gcaccatcaccccaaaatcagcatcccagctctcccctctcctgaacacatgctgcccccagctcagtccacaccctacccttccatccctactccccgttccttttctccttcaagaaccaactcaaaactctgttctaaaaaaaaaaa

SEQ ID NO: 700 - DNA, 114 bp, dog
gcaccatgcccaacatatagtagatgcacaatagccaaatgctgaatgaataaatgaatattttttcttaaggagatgaaatctttattcaaaatttctctgtaaaaaaaaaaa

SEQ ID NO: 701 - DNA, 265 bp, dog
aacgaggcattccccaattccgctgcgccccacaaaatgcatatggacgtaggccaaaaagtgacccgttttaactttccaaatacagatgtgagctttcagaccaacccattctcctgctggaaaagcgggcagcaatggtaaagaatatgtgaagaccctcttgaatttctagtcagtggtcccaagactataaagttttctgtgaactccttcagtatttaaacatttcaacctcaaagtcctagtagggtaaaaaaaaaaa

SEQ ID NO: 702 - DNA, 139 bp, dog
aacgaggcgtgattgttgctaataaataagtcagcctaaaaaaatgtttcttcatttaaagtagatatgattgtaatcacttcttcatgaaaatactttaaatgtagtccaaactttaatctggatgtaaaaaaaaaaa

SEQ ID NO: 703 - DNA, 160 bp, dog
aacgaggcatgtgaaaattatgagcagagaaaactcaagggctcagaagagaccagggatctggaagaaaaattgaaaaggaacttagaagaaaacaagcctagagaagctaagactgaaagaagacaaaaaattgaagagaaagatctaaaaaaaaaaa

SEQ ID NO: 704 - DNA, 289 bp, dog
ttaccgcatatctaaattgttgtccctcattaggatatttgcatatctagtggaaaatactttcttaagcttaagtttggactgactgaggtatatatgtttcagaaatctatccatatattttcaaatatgatgctggtcttacctgtttaaatatcgataaagtagcataatctccaaaaaaaaaatttcttatgtactcaatttaatctctacccatcttggtcagtgaattcttgacagtggtttagagaagccaagaaatgcattgagactgtaaaaaaaaaaa

SEQ ID NO: 705 - DNA, 209 bp, dog
ttaccgcaataatgtgaactaaaagactgctccaggggcacctgggtggctcagttgttgaacatctgcctttgcattatcccagggttctaggattaagtcccaccacattgggctccccacaaggagccttcttctccctctgcctatgtctcttctctctgcatctcttatgaataaataaataaataaattcttaaaaaaaaaaa

SEQ ID NO: 706 - DNA, 219 bp, dog
ttaccgcgtctagtatttttctaagagtaactagagaagtgtttgccattgattttgatgtacaatacagatgtgttactccagcgtgttggctcctgtcccccctccattcattgtatgactattgtaattgtatgtctgaagtaattcagtattttgagatattagtatacccttaattattaatgcaataaaaatctcttagcttaaaaaaaaaaa

SEQ ID NO: 707 - DNA, 185 bp, dog
ttaccgccctatactcactttatatattaatcaccacacaacgtggtaaatattcccaccatatcaaaaatatcaaaccatcattcacacgagaaaatgccctaatgaccttgcacctactgcccctactcctcctatcccttaaccctaaaattattctcggtcccatctactaaaaaaaaaaa

SEQ ID NO: 708 - DNA, 166 bp, dog
ttaccgcaggttagcataataatgagacctcaagattcttggcttttaatgagtataatagaaagaatggatattccttggtagggtccacctaattttgtctttagacttgacacagtaggataatatgatatgctaaggcttgtctattcattaaaaaaaaaaa

SEQ ID NO: 709 - DNA, 160 bp, dog
ttaccgcagtgttgcttgtagtacccaaagtctgctattgagagaccggttgaataaattatcgaatatccatattgtagaaggttgcacgtttgttttttaaagaaattttatcatatgtgtagagattcttgtgtaaacttagagataaaaaaaaaaa

SEQ ID NO: 710 - DNA, 155 bp, dog
ttaccgcctaaatactttgatgataccgcacttgtggtttctagccctggaaagaaatattgcattttaaacattttcaaattaaagaaattttagaagtcatctagcctagtatttttctatttttttggccacattcattataaaaaaaaaaa

SEQ ID NO: 711 - DNA, 145 bp, dog
ttaccgctggttaaattaacaaataaatcaatgaacaataattaaagggtctactgaatgtgtagcaacagagacattgattccaagatatctctatgagataacagaacaatcccttgtttcagtacaaatattaaaaaaaaaa

SEQ ID NO: 712 - DNA, 120 bp, dog
ttaccgcaacataaaaaaattaataatgtagaatggccaaaccaattaattatatgctctaagtgacagaattatatggcatatgaattagatctcaatagaaccatctaaaaaaaaaaa

SEQ ID NO: 713 - DNA, 106 bp, dog
ttaccgctgccaagtctctgctcactttccctctctctgtgtgtgtctgtcatgtataaataaataaaatcttaaaaaaaaaaagtgttatatataaaaaaaaaaa

SEQ ID NO: 714 - DNA, 349 bp, dog
gattgccccccgtgtatatttgttttatgatatgatgataccatagctattgactcctctggtacaagactttaaatgttaactcctatgactctgccagccatggcattgagaagtttgggaggaaactgccattagcataaggctggtgcaccagctgagagggcaaagcctccctgccccaggcagtagcctggtgctaaacaagaagactgtgctctttgcttctgagaatggtataaatgcatatctcacacttaccatgtgatatgtgccatggggttctattgatatgtaagacatgctccctcacttgaaggcgttctgatacagatatgaaaaaaaaaaa

SEQ ID NO: 715 - DNA, 387 bp, dog
gattgccgtggtaccaaaactgggctcttcctttccttcgagtgaggtcgtaggatatatattagcgcaagccggtgtatataccgtttagaagagggccacacatctactggtcacagagttcatgtcaaaccagtgctagaagtttcatgatttaatttcccagcagtgctgatgacgagactgaatgttacctttcctttctgacagattttaaaaattgatatgataaaagcacaactgctatggattctgctgagaactttcatagcaggtatatacgcattttcacagaggattgaaaaacaaacaaacaaacaaaaaaaacaacatgcatgatctttgtttcttttttgataaattggcatgacagagtgaaaaaaaaaa

SEQ ID NO: 716 - DNA, 305 bp, dog
gattgcccacaaatatcccttctatttttcctgtaaatccccaaaccaatcaatctgattgatcattcactttgggtaatgctgggggtgatttaatcaaatggactaatgctgtgataaatccctaaatccatgtgctcccaatgctctgatttgtcaatactttcatactttcataattatctctctctctttctctcaatgttttatttgtgaattttactactctttacaaggtctcaatgccatatcctattctcttcttaaaaggagcccttgttttccactcaacagaaaaaaaaaaa

SEQ ID NO: 717 - DNA, 288 bp, dog
gattgcctgctaccagcccatattgttcaatatggaaaacaagaaccttacatttagcttcaaccctctccagtctgcagtggcgacacatcctgaagataattgtcttcacttcacaattcatccaacaacatgaggatagtaggtaaaggtaagggtaccagtctcctctagaacaccacacagggctgtatgatcactcagaggtaaaagtggtgacgtgagggtttttataggtagcaagtcagagcaggattgataacagtgaagaattattgaaaaaaaaaa

SEQ ID NO: 718 - DNA, 154 bp, dog
gattgccatagattgcagggagttttgaaattaggacatgtgaatctcttttctcaattttttctcttttttaaagattgttttggttatctgggtccctttcatttccatgtgatttttagcatgaacttgttgatttctggaaaaaaaaaaa

SEQ ID NO: 719 - DNA, 117 bp, dog
gattgccaataaatagcatagaaacgccagaagaaatttgtcacacacttagctttttgataaatgaataagcacacattagatccccctaacagaactctttcagaaaaaaaaaaa

SEQ ID NO: 720 - DNA, 270 bp, dog
cgactgtcatgtctagatcttggataaaaagcagaacaaagtgtacattaaaggcaattgatgatgcagctcctcttgttctgttcaaacttaaagaagttgccaaattgtttccactgattaaaaccaccagttgtttttcccattactttgtctcaccaaatatagttcacaatattggctgggcacgtaatttgaattggaagcgattagggtttctgcaaatgcttttccttaaaattaaagaaatttatatgggaaaaaaaaaaa

SEQ ID NO: 721 - DNA, 268 bp, dog
cgactgtaggaacaaaaagatcaaggaggaaatacgaagtgtcagggctgaggaagtaagaaagggttaagtcatgaaaaaccttacctagcaaacttgtaggcatgggattttccctttaaatgggacatttataacctcggtgcatggactctcctcattgaaattggagggatatttaaatgaattccaaggtatcagtgacatcccgaagttgtgtgcaacattttatgactataatcgcatatgaaatttttgaaaaaaaaaa

SEQ ID NO: 722 - DNA, 260 bp, dog
cgactgtcagtagtgtaaggatttgtatggcttcgaatttcgtgggctcagtgactacaaacaaagagatgcaaagtatgactgttaaaacattttttttgatgtgtttctaaaagattttttatattgagacttaatgtttatatttactgagctcctaaaggaaagtggtagaaactcgtgaagttttgtttaggaaaagttgacctgttaaatcctttttaatcgaataaaatttaaagtgctctgaaaaaaaaaaa

SEQ ID NO: 723 - DNA, 211 bp, dog
cgactgtaatggaattatatggtgcttgaagtgtaaatatgagcccttaggaggctacaagggtatttgaggcaacactgatgattgacgttaaaagttgtaacttgagtagcagagtattgaaaatttggtttcagcatagctattgcatgtttctgaagttgaaaatttcaatctaaaataaagtaccacctatttagaaaaaaaaaaa

SEQ ID NO: 724 - DNA, 189 bp, dog
cgactgtcagcttctcaaggggcaagaaccacattttcttcaagtcctgtacatgttctaaggtgcttggcagcgctctgtaccctgtggagtactcagtaccttctgtcggatgttgctgacgagacctaaaaaaataatcccttaaagtacctactattaaaatgtagcaaaactgaaaaaaaaaaa

SEQ ID NO: 725 - DNA, 133 bp, dog
cgactgttgagaggacacgaggaagtgatgttgttgtttcttaacaaacataattaaagtagtttggtctctgaatatagttctggctgtatatcacataaactctgaatgaaagttccttgaaaaaaaaaaa

SEQ ID NO: 726 - DNA, 123 bp, dog
cgactgtcctcctatatgtctgtccacatgtcagtgtgttaaacccccagtgggttccgtttctccttttcccttctggattttaaataaatatttaaaactgaggcaatggaaaaaaaaaaa

SEQ ID NO: 727 - DNA, 245 bp, dog
tggtcagcctggaaccctaaaattttctcctacaggatatggcaacttacaagctcattttttccctaaatagtacattattaagtagcagttttacaaacatacatagtttcaaagtaattaacaaaatattgtcagattggatggagtaaaattcaaatatgttggctataagatatcaaggcattgccctttatatgtaaaaacacaaaaagatcgaaagtaaaacaatggaaaaaaaaaaa

SEQ ID NO: 728 - DNA, 184 bp, dog
tggtcagaaaacaggtttcatgtgaaattattttttgtgggcggagaagagaagaaaagagcaacagaagccttgggctaggagtcatgcgttgctgcttgcataagcagctcagcttttatcactccccaaaaagaacacacacacaaaaagtcactccccaaagagaatggaaaaaaaaaaa

SEQ ID NO: 729 - DNA, 948 bp, dog
ctcaacgactatgtgaagaataggacgcaggggaaaattgtggatttggtcaaggaccttgacctacacacggcagtggtcctggtgaattacatcttccttaaagccaagtggaagacaccctttgacccccgagatactttcaagtccaagttccaagtgagcaagagcaggtcggtgaaagtgcccatgatgaaccttgaggacgtgtgggtgccttacttccgggacgacgcgctgtcctgcacagtagtggagctccagtacaccagcaacgacagtgcgctcttcgtcctccccgacgagggcagaatggaggcagtggaggccatgctgctcccagagacgctgaggaggtggacacactccctgcagatgaggaggatagacaacctctacctgccaaagttttccatctccagcagctataatctggaagatgtccttccccagctgggcgtgagagaagtcttcaccaaccaggccgacctgtcgagagtcacagggcacaagaacctggcagtttcccagatagtccacaagaccctgctcgatgtgaccgagttgggcacagaagccgctgccgccacgggaagtaaagttgtttttttatctggaaagatcggcccactggtcactgttcgtttcaacagaccctttctgttctgcatacaccacaaagatacggagaacatcctcttctggggcaaggtcaccaaccccaatcaagcctaggcctccccccgcagaggtggggcccctttcagaggtctgtgggtgcggcctggcctctctgcaccgaggagccacgtgccaggctctgccctgctcatcctttagaaggtgccagtgactacctggtggcttccagggagcctgtgggctttttgatctgaggccctgaggtctccagacagcaataaactatctttcttggaaaaaaaaaaa

SEQ ID NO: 730 - DNA, 517 bp, dog
ctcaacgcagtactcagtgtacattccaagcctcaagccactgcggccaactcaattggggattcaatcacaggataactgaacctcttttccttgggtagtgtctctagcagagagaacgaccaggacctttcctctggctttgctcttccacatcagactcagtgtcagacaagagattgccaatggacacaccctccctacagtcaccccctctggaagggcttctctccaggtgactctggaccctccctcagctagggacatgctttaccatttggacttgcaaatggcaggcattaaggatcctcttcccattggataacacagagaaagcagaagaaagaagggcaggaggaggaccaagccctgaagaaaggttgactggaagtaaaagtttttacaaaacatttgctaacgagccactgtcaggtccaaattcataactattctgctactagaaaaacagcccatacaggctgacaaaattttcagtgaaacccttgaaaaaaaaaaa

SEQ ID NO: 731 - DNA, 334 bp, dog
ctcaacggaatattgaccaagagagaacacttactagaccataaaaaccttcaataaatttggaagaaattaaataatacagagtatttttctaaatataacagaaataaaatagaaatcaatactaaaaagatatctggaaaatcttcaagtacttgaaaattacacaacacactgcaaattaagtgaggtcaaggaagaatcagctagaaaatttagaaaatattttcaatggaatgataattaagacacatctaaacatgcattggaggacaactaaagcactgcttagagaaaatcttatagctctatctattatattagaaaaaaaaaa

SEQ ID NO: 732 - DNA, 259 bp, dog
ctcaacgcaatgcaggaaagtataaagtcagcaacaaaaaaacctgttactcaaaatacctaacaggtcagacagagttctaaaactttgcccaaaaaaaggaaatctatgggaatctagaatcctgtgcttagggaaagagttttcatgaggataagtagagaatacccttgttggggcatatgtagatgagcagatactaaccagtaagaatggcagggaggctaaatccccatgcttggagagtgaaaaaaaaaaa

SEQ ID NO: 733 - DNA, 99 bp, dog
ctcaacgtggtgtatagggagcattgcataataacaatgcagtaataaatatgaactagaatccagtaagaggaagggctgaaaactgaaaaaaaaaaa

SEQ ID NO: 734 - DNA, 210 bp, dog
cgactgtgaaataaagaaatatgactatttcatacaatatctcacattgtaaaatatcctagtgccttataggcaatcaatttatgttagctacttttatttccttcaaaataggcaattttagacaaatattttttaaaaagaaaaatcacaatgcttataaaaagcacatacaaatatcttctaaacttaaaattataaaaaaaaaaa

SEQ ID NO: 735 - DNA, 222 bp, dog
cgactgttattgtgtattttaaatgcacatctaaaatgataatggagggatgcctgggtggctcagcagcttggtgcctgcctttggcccaaggcgtaatcctggggtcccgggatcgagtccgggatcgggctcccttcgtgaagcctgcttctttttccctctgtctctctctctttctgtgtctctcatgaataaataaataaaatcttaaaaaaaaaa

SEQ ID NO: 736 - DNA, 187 bp, dog
cgactgtggactccaggtgataaagacatgccacataggttcatcagttgggacaagtgtagcagccccctgttgggggtgttgataatgggggaggctgtgcttgtatggggccagagggtatgtgggaaatctctgcatttctctcagtcttgctgtaaacttaaaactgctctaaaaaaaaaaa

SEQ ID NO: 737 - DNA, 186 bp, dog
cgactgtaaaatgggggaaataactaattcatgatcttggggtggtgggatggaaccctgcattgggctctgtgctgggtgtggagcctgcttgagattctccctctctctgccctccctctccctagtcacttccccctacccccaccaactgcttgcacatggcctcactcttaaaaaaaaaaa

SEQ ID NO: 738 - DNA, 216 bp, dog
tggtcagtaacactgtggtcctagactttagttttaaaattttcagctaaataagcatactttaaaattttacttcaactctgttaatagagaactggttaaataaattttggtacatccaatcagaagaaaacatgaagctgttgtttttttaaaaagagagctctatatttgcctatatgaaagaaaagataaattattagataaaaaaaaaaa

SEQ ID NO: 739 - DNA, 133 bp, dog
tggtcaggattagagcattcaaaggttctaaatgaaaaataaaagtactttaagtcagtagagtttcagaatgatttattaagtagcaagtctttcattcaatgatagataaaacaaaggttaaaaaaaaaaa

SEQ ID NO: 740 - DNA, 87 bp, dog
tggtcaaatgttagtgacttttgatgatcgtagctaagcccttttaagaaagtaaaagttatgtaggacctgtaataaaaaaaaaaa

SEQ ID NO: 741 - DNA, 235 bp, dog
  misc_feature (41)..(41): n is a, c, g, or t
tggtcagtagcatgtcatagaaacatgacataattaaagcnttttcattaaatacttgaaatatatttctgaatactacaactcaaaagagttatgtatactttagagaaatattaacccttaaatattgcaaattgctgtttagaaaatttagttctcaggattaccagtaatctctagaacatgtgtgtatgaatgtgaatggaagatgcataacctttagtaaaaaaaaaaa

SEQ ID NO: 742 - DNA, 94 bp, dog
tggtcagtgacttggaggaatgcccttggtaagtactagaagaatatcgtacgctaaatgtatactggaaatccactaatgttaaaaaaaaaaa

SEQ ID NO: 743 - DNA, 83 bp, dog
tggtcagtacattggtcatgccacaggggtgggtttcagactttctctttgaagcagcaaaaccttttacctaaaaaaaaaaa

SEQ ID NO: 744 - DNA, 259 bp, dog
ctcaacgtcaccaagaaaaaaaacagattttggtgtcctgcctttaaacttgatcagaaaaaataaacctaaaatataaatggaggcatttctcttacaaagtagattttcaagtggcacacacatttcttattaccaataaattctttgtttaggatgaatttctataaaatattaacaatattcatttgtggtatttttgttaaatttttccatttttagattgaaaagatatgaatgaatatcctaaaaaaaaaaa

SEQ ID NO: 745 - DNA, 156 bp, dog
ctcaacgatacatctaaaactattcagggacatttttccatttctgaaaaaataaattatgctttataacttcttttgtatttctctgtattttctgatttatttcattgtctttgataaataaaacatgcagttttgttttgctaaaaaaaaaaa

SEQ ID NO: 746 - DNA, 122 bp, dog
ctcaacggaattatcaatgcctgcacctatgctctgccatgaagaggttacaaaacactgaaaatgagcagcgattctaggctaccttaccattctttttccacattcgttaaaaaaaaaaa

SEQ ID NO: 747 - DNA, 110 bp, dog
ctcaacgatactattttcgtattcagctattattattactgttattattcaggtataattattttccttcttttcccaaactatttattttctttaattaaaaaaaaaaa

SEQ ID NO: 748 - DNA, 185 bp, dog
ctcaacgaccagtcagagatgcagaatatacacttttttccctctttgagactatccgggtccagttccgtggcttttcaacgtgatttcctttgtgcctgtgttcgtctgttcgttcttcaaatactgaacgcgcgctctttgagtaaggctctgtggtaggtcttggggattaaaaaaaaaaa

SEQ ID NO: 749 - DNA, 164 bp, dog
ctcaacggcagtggtttgactgttctttgagactggtggaaaaagctagcagggcacctagctggctgtcggtagggcagcggactcttgatcttggggttatgagttcaagtcctattttggggcagagattacttaaaattttttaaaaattaaaaaaaaaa

SEQ ID NO: 750 - DNA, 119 bp, dog
ctcaacgtgctgggaatcccaggggggaaggaaccagtctccttcaaaagtgagggggatttttcccaaggtaaataaactccctcctgattttacatacctatgattaaaaaaaaaaa

SEQ ID NO: 751 - DNA, 184 bp, dog
gagtgctgttggtctgagttgagtcagtgccccttctgaaaccaaggctagcagaagggaattctctggtgtgcttagacctgtgccagatatgcacccctggtaaaccacttgcagtgggcttaactaaactaaagtacttgaattgagaaaagagaaagagttatcccccgaaaaaaaaaaa

SEQ ID NO: 752 - DNA, 212 bp, dog
gagtgctgggattgtgttttatttggcagtgatgccaaactagcaaggcttagggaaatgtcaaaatatcctgataacccttgtactctgttatgtgccttcatctcagttcattgttaagtcacagagactagctaaattcaagtattccaaatccatgaacatttgataaatgactctggtttagatataaccattttagaaaaaaaaaa

SEQ ID NO: 753 - DNA, 223 bp, dog
gagtgctcagtgtacaggaacgtgtattaactttttatggaaaaacctcaaacatgcacaagttgaatagtgtggaggacctccatgtcttcagcctcatcaatggtcaatttttggccaatcaccaatgtcacctgtaccccacctcagattagtttgaagcaggttcctggtctgtcactccatctgtaaatatttcagtgagtatctcgaaaaaaaaaaa

SEQ ID NO: 754 - DNA, 250 bp, dog
gagtgctcaccacacctgtttgttggtggactggatgctgaaggagggaccaaatagcactttcagagattttgagctgaagaattttggaggtgtgggaccactatcatcagggcaagaacttaaggaaattcagaagtcctaggtcattggaggcatctcacaatgttgacatgggccatgaaattaacattaatatgtgaatcagtggacatagatgtggtgggtaactgaggttgaaaaaaaaaaa

SEQ ID NO: 755 - DNA, 294 bp, dog
gagtgctatagatttgctccaggaagtccttggatctttcccatacactaagtttctaataaacagtgtcttccaaatgtattactattttttagaataaatataaatgctcttatagtaaataggagtatagattcatagtattagtgaattaatgacagctttgaggaattaacatatttgtttagcaggtagtagtgaaactgctgtcgttggatacatgagacgtttttcaatattgaaatggattcctcgcaatcagaggctgagaactctttgcttgaaaaaaaaaaa

SEQ ID NO: 756 - DNA, 368 bp, dog
gagtgctgggtggaaataggaatataaaaactgtctttaaactctccccattttctgaataaaccttctttcaagactacctgggtccctaatccatgctgcttcctacaccatgacacactttatccaacctcataaagtaactaactatcatacgcttatcagcactggggagacagagctgtttcatgagctcaaggaactcagagtctaggctgggaaacagattgagaaatggacaattataacactgcagtatccatgggacagactgaggaggaaacttgggtggagtttcaaatgatgaagaggagatgctcaagagaagaaagaataatgctcaagagcaaatacttgaaaaaaaaaaa

SEQ ID NO: 757 - DNA, 477 bp, dog
gagtgctgatcttactgggaatgttattgtgctgttttaagtgatgtatcttgaagctatttagaaatctaacatttctttttcttcatcttgcaagtgggaaagcagctgtttttaaagggaagaagcattagaatcttggcagacctagatacaaatttccatcctttaaaaaaaaaaggaatattatgctatcctttgcagagtatctattctaaagggttatttgaaaataaattgaactagtagagtgtggacgatttttttctccagattttatctagaaaactaaaactcagagaagttatgtaaccgagccagtgaggggcagatcccagtccattgacccagttttgttgctgttcacttatcctcctgtaccatccaatgcctttcaaattgctacaacatccatacacggaaggcctttttacatgtaaacatagtttgtatacattctctgcggaaaaaaaaaaa

SEQ ID NO: 758 - DNA, 519 bp, dog
gagtgctagaaataccaccagtgtgtgacactgtattaatatctcggccgctactctgttgcaaagcattatccctttgtcagatttagttgaaatcaggctcacagtgcagcatcgttaaaatgcgctgcccctaaagaaagatgcggtttccttctagcggcaggaaatgacccaagactcttctcaatgtcacatctcgttttgtaaagctgcagactcccagcacactggcacatagaggaatcacgctgtttaaactccctgatcaagaagagcatctttttctgagcagttaatgatttttactctccatcaaaacctctcgaaaagatgtgtcacgtctaaactggtgcttgtgccgtgtcacccagtcaaatctgcttccctaatgaaatctgcgggtgaatttgatagaatggctacagttaaatcacccttatccgggactccacacgatcttccttttaatcacagggacagaagatccctgtggtagtgttcatttgaaaaaaaaaa

SEQ ID NO: 759 - DNA, 142 bp, dog
cgggtaacacatgagatggaacgtcagtctggttgtaaatctccgctcgccaggaacatggagccccgatatacacgtgtacgtgtgtcgtgtccgctgaggcgtgaataaacttatgtaactgtgaggtgaaaaaaaaaaa

SEQ ID NO: 760 - DNA, 148 bp, dog
cgggtaaccagaaacacgccattgtgtgcgaagttctccaagggagagctctcatggtagagaccaatgaagacccagtaagctgcttccttcctgctgctggtgtgaaggattctgaaataccttgattacacttgaaaaaaaaaaa

SEQ ID NO: 761 - DNA, 312 bp, dog
cgggtaaccagtagaacagaaaacatgagaaaattgaactcagaatagaaaaatcagaaaccaggaagactatccaagagaagaaaaagcatgtcctagagctgttgctttaagtgtggcaaatatgattctacttaaaatctttatgtttgtgattaccctggagattgaaacagtctttcagataaatactttttaattcacgttgtcctattgtagttgttcaaacaattgagttgtagaatttctcttccttctgacaaagaacatttatgttccatagccagtttctcataaatcgaaaaaaaaaaa

SEQ ID NO: 762 - DNA, 360 bp, dog
cgggtaagacctgtcattttgttagatgctaattatacaccaatacaaaactaaaggaatgaaccacaatcagttttgccacagtgatgctattgtacattcttacagcagtacattaaagttcctatttctccagatcttcatcaacatttaatgttgttagatctaaatatttttaaaacatatagtaaatagtgacatttcatttggcttcttaatatttgcatttcccagattcatttctggatgcattttagaattaacttgtgaatttcattttttttaaaaaaccctacttttattgggattatacggagtctctatgtacatttaacaagtgcaaactgtgaaaaaaaaaaa

SEQ ID NO: 763 - DNA, 361 bp, dog
cgggtaagacctgtcattttgttagatgctaattatacaccaatacaaaactaaaggaatgaaccacaatcagttttgccacagtgatgctattgtacattcttacagcagtacattaaagttcctatttctccagatcttcatcaacatttaatgttgttagatctaaatatttttaaaacatatagtaaatagtgacatttcatttggcttcttaatatttgcatttcccagattcatttctggatgcattttagaattaacttgtgaatttcatttttttttaaaaaaccctacttttattgggattatacggagtctctatgtacatttaacaagtgcaaactgtgaaaaaaaaaaa

SEQ ID NO: 764 - DNA, 396 bp, dog
cgggtaataagtttgggaccacatggataacagcagttcatattaacaaagacttggcacctgttttataagttcatggtagaaagctgttctagagcttttacagaaggaattctactaataaaccactgatagtacaagtgtttaattctaaaagtgtatttgtgtaactttttctatctgcctttttgataattctgatcagcatatttccattgaataaatgggaaagagtgtgctgaccccaaacatcctgataagttaaaggccttctgggaatatattctagatttcgagacccttcattcactccctgtcgctccagcatgctgtcgtcaagataaataagggctgttcctcttataacagtagttctttaatttagaaaaaaaaaaa

SEQ ID NO: 765 - DNA, 435 bp, dog
cgggtaatgttaatatgctctagggatagcaataatgcagtaaggaagtatgttacaaaagaatagatgtatggactcaaatgtcactctaaccaactatcatttttccatcaagtactactgaagttactagttatgtgatcttgggtatgataatcaaactctgtaccccagcttcctcctgtgtgaaatggagataattacagcacttagctcagaaggatttcatgaagattaaataagattacataaaataacacctgttaaatacctggcacttcctaagagtttgttaagcatcagctatttttatttagtgtacttactagtagcccattaagtgtttgacgctacagagctagagttggcaatccacagctgaaaatgatcagttaagtatgatttttatatttaagagttgtggaaaaaaaaaaa

SEQ ID NO: 766 - DNA, 503 bp, dog
cgggtaactaaatggcttttaagggggaatccagggatttaatacaagacaagattccatataatattatcttaaaaagcaacgtgttaaatctgattcaattctatcaggaaaccaaagtattacagcactaattcccatgtgaaaaaaaaagggactaactctcccttagcaataaggtatattcgatctattcaatccaatttttcctcaaacctgtttcaccaaagaacctttacctttaatattttaggtaagccttgcaatctaccacaatattgcactcagtaaagggtttctgaagcaggcacatttatgggacagtgggagaagggttcatagcattaaaaaatctggtccaagagcaaattacagctcttacaggaaactttaaggatccctcctagaaaaggataacctcagcttaatacataatactatccaatcacaccacccttgtatcccctgccaaaaatgtttactccattattgaaaaaaaaaaa

SEQ ID NO: 767 - DNA, 591 bp, dog
cgggtaacaagaagcagtgcagaagaactatataaatatggaaagagattccctctgaggcatagtgtaaaggaaaaacctaaagctgagaatggacattgagaaaaagcccccagccaaccaatctccaccctaagcacatagtatcactagagaaattttaaatctatgatgcattcattgtaagtaatcataataataatagtctacaataccagctcaattcctgactagattgaccaataatccacactgaggcctaacagaaagaagtatttatttccaggcataaaaaccacactttaggatctactgtcctacagaagatatctagccttcaacaaaaaaattacaaacatacaaaaataaagcaagaagaaacaacacactatttaaagtaaataaatacaaaaagactcagatataacacaaagtttgaaaccataaggcaggaaatttaaaataactataattatatgttaaaggctttaatgggtaaggaagacagtatgcagtatcagacaagtaatttcagcagacagatgaaaacaacaaagggaggttcgaatagagatgctagaaaaaaaaaaa

SEQ ID NO: 768 - DNA, 616 bp, dog
cgggtaagtatgagctaggatagtaggataggagagcccttgttgagaggttactctcagatcctagtcagggaagcactctgagaagctgacaattagtgttattactgagtcacaacagaatcatagaaatgagtcggatctaggagattttctggttcctgctttacacttccatatgaagttaagttgccacggattaggcaactttggttctaaaatgaaaccaacagaccactgttttaagtgtatttgatttttattatatgcataataaatgtatcctaaaaacaaggtcttttggtacctatgaaatacttggtttgaaaaaaatgtacatagctactgttttgaatttctgacatttctctgtgattcttcagggtgacgtgtagcctatacagcaaatgtataagattaagaaatttgtagatggtttgggaacggataagttgcttttccgtactgattctcccgtattcgaagcggttcactaaatatccctgaagcgtgtgttagaccaaaacagcgacttttgggctctttcctctgtgatatttcctttcaaataaagtaatttagccattatatcctcccccgccctgaaaaaaaaaaa

SEQ ID NO: 769 - DNA, 116 bp, dog
ccacgtaatattgcacctcggatcaagaccaggttgctcctagtcttaaaaaagaaatagaaacaggtccttgtttctgtgtctctcatgaataaataaaatccgaaaaaaaaaaa

SEQ ID NO: 770 - DNA, 144 bp, dog
ccacgtaggggacacagagcacctggtcctggtgaacagaggacatcgtgctactgggcatgacaggacttctctttcataagggcactaatttcaagatcaggagatgtagctgactttactaatacataggaaaaaaaaaaa

SEQ ID NO: 771 - DNA, 164 bp, dog
ccacgtatacaacaaatcatccctagggagggcagtgtcatgatatgaaaaaggaacaagaaatgatgtctgattcccatgagaaaaacaggtcttatgtgaaaattaatctcagtgtgttacaacgtttgctacataaacctgaacaaaaggaaaaaaaaaaa

SEQ ID NO: 772 - DNA, 167 bp, dog
ccacgtacacacaatctcctccaccaccaaaaagcaagctgcttttaaaatttttattcattttcaaactgccaaagattcccccaggtgtcaattttgtctattttgaaaggagtgataatattttctctacctacttactgggcctttagtaggaaaaaaaaaaa

SEQ ID NO: 773 - DNA, 173 bp, dog
ccacgtaccccataaatacacttgtattcgtcagcccgtctgtcctggttttgttggtttggaaaatgtggtcactgtaaatgttctatttatttcccaccaaccatccaaaatttctcttttatgtttaacaattttaaaattatcttagctgtctttctgaaaaaaaaaaa

SEQ ID NO: 774 - DNA, 155 bp, dog
ccacgtaaataaatagatttatgttaacttcaataaggttagtggagacaatgaaatatcacgggaaaacaagaaatcatacatgatttgtaaactgtgaaaatatcagagaaaactattagtccaaaggaagataaaggcatgaaaaaaaaaaa

SEQ ID NO: 775 - DNA, 190 bp, dog
ccacgtatgaaactagaaatgaagagcaaaataaacccaaattaaacagaagaaagaaataatagagaacaaaaatccatgaaatagaaaacagaaaaaaaagaaaaaatcagtgaaactcaaagctctttaaaaaaaaaatcaataaaattgtaaacctctagccatactggcaaaggaaaaaaaaaaa

SEQ ID NO: 776 - DNA, 212 bp, dog
ccacgtagagaagtatggtgttttcagaaggagtatgcataaacaaagccacctggtttatagaactatccccatagagtgattccctttccattctcattcaactcttctcagttcttctgaattcttcaaggaagatgtctccacttggaaatactaccatttttaataaactctctgacatgtgctaaggttcaattgaaaaaaaaaaa

SEQ ID NO: 777 - DNA, 231 bp, dog
ccacgtatgtaacctcaccaactacataagacatacaaaaggaagataccaagaaacaatacatttaaacaccagtatcttgctttactgcacacctgtgcacaactctacagaaaagcacctattattcaccaacaatcaaaaccagaccaacatacctcctatcaatggctatgtaaatttaactaattttctaaaatgtacatcatccactttctcgaaaaaaaaaaa

SEQ ID NO: 778 - DNA, 235 bp, dog
ccacgtagttaggcattcaccccttcatgtagcattttgaagattttgtcacatctacttctttccatgcacctctccactgctaaactgtgagttccttggagccaaggctgcttgctgactctgctttacatccttgtgttgctaaacactgagcccaactgtctgatggtagatgctccctgcatgtctgacaagtgaatgagtgaataaaacccatatagaaaaaaaaaaa

SEQ ID NO: 779 - DNA, 272 bp, dog
ccacgtagttacaggtcacactttcaaggacgtaacacaagatggaggcctgcagcaaagtttgctactgaccaaacagaaacacatgcaaagcacacgagattggctacagcttaaggccaacctcacaaatcctttttcataattcaaactttacagataatataaacagtgatccttatcactcctggcatagtatacatcttttaaaaagaaaaaaaaaatgcttcttttaaaaaagttaactcctgacctggtggagaaaaaaaaaa

SEQ ID NO: 780 - DNA, 297 bp, dog
ccacgtagctgtgattacaggcatgtgccaccacacccagctaattttgtatatttagtagagatggggtttctccatgatggtcaggctggtctcaaactcctgacctcaggttacctgcccgccttggcctcccaaagtgctgggattacagtatgagccaccatgcccggacagaaaatacaaattcttgacctcgtagctttcatagtttagtgaagagattcaaaaaaaaaaaagtcaatagtaagataaacagtgcattgcatggtgataagtgttatggaaaaaaaaaaa

SEQ ID NO: 781 - DNA, 326 bp, dog
ccacgtaggttaaatggagaactgcagttaagttagagacaaatgtaacttgatctgattggtagaacattgaggtaggaatgaaatttttcttgcaggttggaggtgcaaaaagcagggagatttagcttttgcaagagcatcataaagagatgttctgtatggggtgggggaagaggggagggatagcattaggggatatacctaatgtaaatgatgagttaatgggtgcagtacaccaacatggtacatgtatacatatgtaacaaacctgcacattgtgcacatgtaccctagaacttaaagtgttatttgaaaaaaaaaaa

SEQ ID NO: 782 - DNA, 340 bp, dog
ccacgtatcaactttatgggacttgttggtttatatgcttgtgtcctcacactagtctgtggactccctgaaggcaggggttgtgtcagaatcatcttggtgccccagaatgacacccagtacctgatagacataaagtgtgaaatgaatgagggatgcaggccccaaaacccagagacttaccatctgaaatagaccacagcaccatgtacagcataagaactatgtttaataaattacatttctaaattatactgagcaaacacaaaagattaaatacattaactggtgtggggatggagagaaataaggatgtaaaagctttactgaaaaaaaaaaa

SEQ ID NO: 783 - DNA, 343 bp, dog
ccacgtaaaggttagaataaactaggctgtatctatagaaaatcctggtgggattttgtctggaattgtgttaaatctatagagcaatttggggagaattaacatctttctaagtttttcagtctctgaacatcctgcaactctctatttacttaggtttttaaattttatttcatcaacattttgttgtgttgggcgtacagatactatacatattttgtcccatttatacttaagtattttattattttggaactcctgtacattaaaaaaaatctatttccaattgtttgatgttaatccgtagaaataaaattgatttttgcatgttgaaaaaaaaaaa

SEQ ID NO: 784 - DNA, 358 bp, dog
ccacgtacaggtgagaacatgtgatatctgtctttctgtgcttggcttatttcacttaaaatagtgaccgccagtttcatccatgttgttgcaaatagaggattttattttttaatggctgagtagtattccagtgctcacatacacaccacattttctttatccattcatccactgaaaaacacttaggtttattccacatcttggctattgttaaaagtgctggaataaataggggagtgcagatacagatacagcttcaatatattggtttgctttcttttgggtatatatactcagtggtgggattgttgaattatatgttaggtctatttttagtttgttggaaaaaaaaaaa

SEQ ID NO: 785 - DNA, 371 bp, dog
ccacgtagctagtcttccttcacttgttaccagtgcttcccatgcccatcaagcacacctaccttctacaaccagtataacttacttcctttcatctcctggcttagagctgctgctgagaattgtttttatttacctttatgaccttttatggttctctcctgctactctagaacccttctacagtgccagtgccttttagccattgacattgggattggctgggtgttattattggttgaaaattctgctcttggggagcctagctggctcagacagtagagcatatgactcttgatcttgggatcatgaatttgggggtagtttacttaaaaagattctgctcttgttccatccttgaaaaaaaaaaa

SEQ ID NO: 786 - DNA, 429 bp, dog
ccacgtacacttaatggcttactgggaactgtataaaaagaacctgaaaagaacgcagttcttttcccagtttgtaataccggaattaatgcgtgcaactatgcatgtgatgtaccattgaacgttaacaggattcaaaaactaaatattaaaaaaaaaaaacctaaatattcaaaacatacttagcacctttgtataataaacatttacactcaacaattttatgaaggagatgtttatttttaccatcacagttctaaagatgaggttcttaaggcccagatcatttaagtaacttgcccaaagttatacagctagttctataagagaactgggattttagcccagattcatttgatgccagtacgcacaccagttcctttgccctgtaccatgctgcctgggtattttaactttgaaaaaaaaaaa

SEQ ID NO: 787 - DNA, 140 bp, dog
cattccgcacaggttgtgatcctggacttccaggatcgagtctcgcattggggtccccagagggagcctgcttctccctctgcctatgtctctgcctctctctgtgtctctcatgaataaataaataagaaaaaaaaaaa

SEQ ID NO: 788 - DNA, 148 bp, dog
cattccgcagtcccggatcctccctctttgatctttcccttcctgtttcccccaatgtttaaaatgtttggatggtctgttgttctgcctggggacaaggtgctaatatagatttaagcgaatacattaacggtgcgaaaaaaaaaaa

SEQ ID NO: 789 - DNA, 156 bp, dog
cattccggtaaggagatcatataatgtccatgtgttcccatatgcgaaatgtaaataatcaaaccaaatgatccaagtttccttccatttctgactgtgaaagattctctgagactccaaggtgggaggttttgaggagcagttgaaaaaaaaaaa

SEQ ID NO: 790 - DNA, 173 bp, dog
cattccgtcacgggccaataaatctgactgattttggaatagagtattaggaaacccattatgcccctgcacctgagccacattctcccttcccacctttattagtattaagaggtaatatttttggatatccatatattcattctttgtcttatttttcagaaaaaaaaaaa

SEQ ID NO: 791 - DNA, 254 bp, dog
cattccgggatcaaagctgaaggataaatccctttctaggacaagttttaaaacttccactcagaagtgtgacaagatactcccagtcacacttcattagctcataaagtgatatgatcaaatctgatgtcactggggcatgttgtctgtattagaaaaagccagaaaacctgacattaataagattttccctaccatttgttagactctgttaatgacaaactcagtatttgtttgcttgggaaaaaaaaaaa

SEQ ID NO: 792 - DNA, 271 bp, dog
cattccgtgtatacatgcctaagaagagccaaagcagctgatatatgaatatcatatttacatgcattcaataaatatttattatagacctatgaagtgtcaggctatgttctaggaactggggatgcatcggtgaataaaacaaacaacaaaccctgacgttgaagagtttacattctagtgggagagagataacagattctaaacaaaatgtgtatgtgtttaatatccagtatgttagaatctggtaagtgttacagaaaaaaaaaaa

SEQ ID NO: 793 - DNA, 299 bp, dog
cattccggtcctccctactgtggatcagctctcctgtacctaaggataaatcttatgtataatgttgacacgagctctgaattgattctcatctgatatgcaacctttgatagtgatttgttctcttcttagtgttcattgcctttggtctggtttccttttaataagcaaaatgtaattaaacttggaggcattacttgaattccattccccagtgccttaaactttctcttccaaatcaatttaatcacagaaaatgtcgaagttaaaatagatcttggaggggggaaaaaaaaaaa

SEQ ID NO: 794 - DNA, 333 bp, dog
cattccggtgttctgggatcttcatgtgtcttgtttatggatagttgaaagttggtcttcttgtgaggggaactgaagtcaggaacaacctacgtcaccatcttaataatgtcaccctccctcttccttcttggggacccaagtttccatggtattattttccacattctgaaagaaaaaacaaattgctattttacatgtaatagaaatgtaatctgaccgccacttttctatgtttagcatgactgtgaagttgagtttaaaatagggtaataaagagggactatgagaaatgatgctggaaggataaggaaagaaatggaaaaaaaaaaa

SEQ ID NO: 795 - DNA, 356 bp, dog
cattccggatttcaaagctggctataaggcaacagtgatgaagacattgtagtattgacataggatacacaacaatgggttagagttaagagtctagaaatcaacatatgtgtatgtcaactatttttgacaagggtgatgaaccatttaatcaataaaagtattttcaattttgtatggtggcatatggtaactagtagttatctattgcataataaaaatatccaatcactgtgatgtacacctgaaactgacagatactatatgtttctgaaatgagtagacactatctttttttccacaggaaaaaaaatattggtactgagacaaatggatatcaacatgaaaaaaaaaaa

SEQ ID NO: 796 - DNA, 413 bp, dog
cattccgagcctcacaaaagtcctcaaaaaaaaaaaaaaaccctcctaaaacaaatcctaccacgagaaaattgttttgatttttaaaattagttcactgttacagaattcaactaaagctaaagagaaacaactcctttcagagaagcacgtggcaggaaggggtaatttcaactttcaacatataaatgcagctttaaagattcagaccttaggtccaacacctgcttgctattgatcatgcacgttcttatctccaaactgcttgctcttttttttcatccgcaacaaactggtaaagcgaatgcaaaaatcaagacaatcctgtgaaactcacagtgccctagaaacaactattaaccgccagtgaaactctgaccatgcttcacgcacatgtggtggaaaaaaaaaaa

SEQ ID NO: 797 - DNA, 542 bp, dog
cattccgcataattgttctggagttagaagaggctatgatattattaatttcctcttctatgaaagagaaccagttctgagactattaagttatgggaaaaaaccttctccccaccccactttttcttcctcacacttccttgcttcaagtcagcttttcctaattagtcagatggagaactaatggagttgttggaaggctgatcaagtactgcacagccccagaaaaacatcaatcactatttggagatgagagactctatttagcaatgcaatgggtttgtgtcttgaaagggttcaagtcccggccctaaggaaagttgcacagaatcctctgattttaataccaagtatctctccttattggtaaagggaaaccaccagtggtggaggactgtaatcaccttcatgtgcctagtgaagtcccttaacatccattcttagtgggatgtgctagtaccagctcttggcatatatcatataggtgatagaattccctgcagagcattggttatttattcacttttttggaaaaaaaaaaa

SEQ ID NO: 798 - DNA, 693 bp, dog
cattccgcacaatcctctttcttccataggaatagagttacagctgaacccaaggctgcctcactacagattatatttcttggcctcactagcagctagctctggtcatgtgaccaagttttggcaataggatgtgaacagaagactctgaatctttccattaaaagaagtccataggtgattttcctgttcactttccccattcccactggttgggagacaatggcaaccagactagcttttttggacaaagaggaagaaatcatgtgttgcagaaggcagtttcttccttccatttctggactatttggcggaagagaaataaattatatggtttaagccactgtattttgagttctctttgtacactttagcctgtactttaaacaattcattatttatgaagcctgttggagcgaagatgggtctggcaggaagatcaggattgcagtaagtgcacagctgttaattctcagacttttacctttttgaagattgttttttttatgtatatgtcttctcttttttccttcaaacagaaaagaaaataatcctttagaattataaacagatttataacccctacgtgtcagtaatcttcaagtattttaaagtcttcattctacttttgtagtgctaaatttccagctaccaacatgtcatcttggttgtcatcacaccgaaaaaaaaaaa

SEQ ID NO: 799 - DNA, 164 bp, dog
ttaccgcagccttagaaaattgagtattgaagcatttcaggaggttattgggaggagaataatacatcttttctccgattgtggatatttacaggatattgccaagctagtaagacagtaaacacctaaaccaagaaattgaagttgctttcgaaaaaaaaaaa

SEQ ID NO: 800 - DNA, 334 bp, dog
ttaccgccaaacctaaagcctgcacctccacccacaatagaagagaaagttgctaaaaaatcaggaggagctactatagaagaactaactgagaaatgcaaacagatcgcacagagtaaagaagatgatgatgtaatagtgaataagcctcatgtttcggatgaagaggaagaagaacctcctttttatcatcatccctttaaactcagtgaacccaaacccatttttttcaatctgaatattgccgcagcaaagccaactccaccaaaaagccaggtaacattaacaaaagaatttcctgtgtcatctggatctcgacatcgaaaaaaaaaaa

SEQ ID NO: 801 - DNA, 415 bp, dog
ttaccgccataaaaaaaaaaagactaaatgtgtgattgaggcagtttttatatacaacacaaaaagtgtgatccatgaaagagaaaaattgataatatgaaccttattaaattttaaaatgtccattttgtgaaagtcattgttcaaagaatggaaagcaagccactggctaggggaatatattttcaaaaaacatgtcttgagaaatatatgcatgcagaatattcaaagtcgtagtaaaaacaacttcaaaataagaaaataaactccccaaattaattaaaatgagtaagacaatatgagtagacaccttaatggatagtatatataaatgagaaataagcatgtataaatgggtcaacatttggggaattattggaaaatgatatgcattgtgaattaggaaaaaaaaaaa

SEQ ID NO: 802 - DNA, 433 bp, dog
ttaccgccagaatctcctctatttacaactgcattgaccacaaaggcatataattttagctcacaaggtctaaggaaaagaaacttgcaaaggagatttgagtagatttcagcaaacatcagatccaagtaaagttctggtggcaatagacagaatgattttgactaaaatggagatttatgtctgatgcttatcacagcaagaatgaaaattccaggattgagggaaatcgttgggctggaaatccagttagagttgaatgaatccagttttacagagcaaattatatatcctgtacattaattaccagtttccaccttaaagcttatttgccctgaataaggggcttttcatcctttggtattttgtgggcaggctgcagttatttagttctcagaagggaaaggttaaacatgtttccagaaaaaaaaaa

SEQ ID NO: 803 - DNA, 442 bp, dog
ttaccgctttagcctaatcaagtgaaaggaccataaagcacactcccctctagataagtcaggaatctcagctgtgtccaacttctatatcctctcatttggaatttagcatgcttctttaggagcagtaagaagtttagaatggagagggagtaattttgcaagatgtatggtagccgactcatacgagtttcattttaaagccatgtggttcgtgtgcctacccatgtctaggaaggagcacaggcgtgactcattttccatgaagtctccatgttgtaaaacaaaaggaatatttctgatcagactgaggacacccccacattctgaaacttaacctgatctcaacctgggaggtgcccaggaacttaacatctattttacgttgacatcctcagacattttcttgaggagattgagacttgcctgggaaaaaaaaaaa

SEQ ID NO: 804 - DNA, 537 bp, dog
ttaccgcagaagagaatattcatagatcctagtgattaggacatggacatctctgaagccatcactagcctaccacagtgcccttaaactccagtccagtggttcttaaatgtgattcttggaccagcaagatctgcattctctgggagccttgtgaaaaatccaaattcttgggagccccagacctgctcattcaggaactgcaggagtggggtttagcaactggtgtttgcataaacacctcccggattcggatgcatcctacagtttgccaaccattgtcttcagctagggttcctttctctacattatggttccccatcagagttcattcagaggttctcagataatcttcccaacttcgtctccacctctctgtcatctcagatgggtgggtgaatgcgtggacttttgcttagaagaaatagtaccaggattgattagcaaagcccctcccgaccagagagagacactgttgtcagcaggttcagccctccttagctctctgggggcaatttgtgattggaaaaaaaaaaa

SEQ ID NO: 805 - DNA, 130 bp, dog
aacgagggcaaggactttgccaatctagtttactgctatgttcttgaacctgtatataatcacagaagatagtaggctatcagggagtctgttaaagggagggaaaggagttgatactgaaaaaaaaaaa

SEQ ID NO: 806 - DNA, 139 bp, dog
aacgaggcagacaaataaagattcaaggttttaattaattcccgtactgataaaaataattccatgaattctgtaaagcattgcataaatgctgtagtgtaaaaaaaatttaaacaattgttaacttgaaaaaaaaaaa

SEQ ID NO: 807 - DNA, 143 bp, dog
aacgaggggagattgcttaactcaaagtaacattttgcatcatgaaaaatgatgggaaattttacttgttgaatattgcttcacttcaggggttctgtgttagtacaactattaattaaaaataaatttgtgaaaaaaaaaaa

SEQ ID NO: 808 - DNA, 147 bp, dog
aacgaggatgaagattcaccaaacaagctctacacgctggttacctacgtacctgtcaccactttcaaaaatctacagactgttaatgtggatgagaactaatcgctgattgtcaaataaaggtataaaactgcgaaaaaaaaaaaa

SEQ ID NO: 809 - DNA, 220 bp, dog
aacgaggacaggccatcagggctgccaaggaagcaaaaaaggctaagcaagcatctaaaaagacagcaatggctgctgctaaggctcccacaaaggcagcacctaagcaaaagattgtgaagcctgtgaaggtttccgcaccccgagttggtggaaaacgctaagttttagtggatcagatttttaaataaacatctgactctaactagaaaaaaaaaaa

SEQ ID NO: 810 - DNA, 364 bp, dog
aacgaggatgacaattggtgtatactttttaaaatctctagggcctaaggcccaatgaccaagggaataaaaagccgcaccctttagaaaccctgacactcccattgtgttttcatggtttcactaatatgtagtgttccgtgtgagaaaggtgagggttttatgttctagaatcatgaacaaaactgtccttgggagtgataagaccatgctgcactgctacatgtgtgtttgtgtgttcgatgtggaaaaaaaggttctgggctatgtctgtatttgccatttacttatcacataatggtgctgcacaactactctataacagtgttattttaacttgaaaaagcatgaggaaaaaaaaaaa

SEQ ID NO: 811 - DNA, 210 bp, dog
gcaccatcccagcacatcatgatttccagcaaatatgtactatggatttgggtagtagttttgtacagtttggtcagttatatattctaaatatgtaatttctaaataaccgtgaatggtattgtgttttaaatctctcatccatgtgtttgctgctagtagatataaatacaattgatttttgtacatttgtatcctgaaaaaaaaaaa

SEQ ID NO: 812 - DNA, 279 bp, dog
gcaccatgatgattttctcattacttgcatattttaaaatttgaattttttctcttttttttcttttagaattgcttttttcacctgctgtgtctatttagttatagtaaagtatagcttggagcacctgcgtggctcagttggttcagcatttggcttctgctcaggtggtgatctcggggtcctaggatcaagctctggggtgggctccctgcttgtgcttctctcattatctctatctctctcaaataaatgaataacacctttgaaaaaaaaaaa

SEQ ID NO: 813 - DNA, 387 bp, dog
gcaccatggaaaagaactggctattacaaagaaaaaagaatggaatgttaaggttagaattttcagtgatttaaagtcataactgacttacagagttagtttgattggaagatctacaaagacaagaattgagtctttcctttctctaacagtatctctcgtggaattatctttcaagttaggcagagtctcgccaagggagacactactcaaagtgacagaaacaccttgtttttaactcagaccattaccttcccagcctgatcattcacaggacttaatcttatatgacttgtaaaatctaataccccttcaaaggctggaaacttggtcattaaaatcaaagactaaacctctagctctaggaccattccagaaaaaaaaaaa

SEQ ID NO: 814 - DNA, 419 bp, dog
gcaccatactctaaagtagactcaaaatgtattaaagacctaaatgtgagattagaagccataaataaagataggctgtaatctcttggacatcacccttaacaacatatttatgggtgtatcctgaagcaatagaaacaaaaggcaaggtatcagaactactcaagaataaaaatcttttccagagtagcggaaaccatcaacaatgaaaggcaacccactgaatgttaaaagatatttacaaatcatatatccaataagggattaaacagacattttttccaaagaagacatacagatggctaacatacagatgaaaagatattcaatatcagtaatcatcagggaaatgaagatcaaaaccaaatataaccttacattaatccaattggctagtatcaaaaactgaaaaaaaaaaa

SEQ ID NO: 815 - DNA, 155 bp, dog
agtaggcatgtttgataaggctgcataaccagtgtgatggtttaggtcacattctaacagataaagccaggataagtttaatttttctggtcatacggatttgagaggcctgagtatgcctgcgcatgtttaaattcttcactgaaaaaaaaaaa

SEQ ID NO: 816 - DNA, 155 bp, dog
agtaggcatgtatggttgtaggctggaaaagaaaaatagaagctctacttacctttgatcttcttaacccttactctggaagttaacaaagatttactgttctttgggactttcagtttaggataaaattgtggtggatgccagaaaaaaaaaaa

SEQ ID NO: 817 - DNA, 180 bp, dog
agtaggcatcaattggatcctttcctatgttgaaatggaagaattaatgagcttacattaattagtattgtaatgtgtaaaggaggcccagcaaaattttttgaaaacttgatgatcccaacgtatttaccattgtatgttaaagcaaaataaatcaccatttttttagaaaaaaaaaaa

SEQ ID NO: 818 - DNA, 217 bp, dog
agtaggcaactgaaactaccagaaaaattacagttgtgcagaaaggattaagatcctaggagtaaatggataagttctgtatagaaatgtgcaatcttgtatgatgaacactagacacatgggtattgggaactttaaatgtggctagtccaaattaagatatgctgtcagttaaaatacataccaattttcaaagacttactatgaaaaaaaaaaa

SEQ ID NO: 819 - DNA, 245 bp, dog
agtaggccacatccaagtcaattaccatctctgattataatgaaatagatccaacacactaattagggtctcttcctatagcccctgccaagcttgctgagattctcttgtcaatattctccttcacctttcatgactccttcctaattgggcatcattgagatttagtaatgatgcttcatattatggtggcaatctgatcccaagtaacataagtggaaatatttaactaggaaaaaaaaaaa

SEQ ID NO: 820 - DNA, 560 bp, dog
agtaggccattattatattttccccctaaaaaagatctctttctgtttcatttccatggggaaaacaccccactgattatatcctttatttcacttttaagaatcacaccaaagaaaggaaataacctggaaatgtattgttcattgttactgagttctagaatataagttgaacagtatatgtggcacatattaatttgataaagtaaaatctgatgacattgaatgttagattagacacaaagtctgaagctttatttccactctgcatttgtagggctggtagacagaaacaatggtctgcatgatttgggccagctctctccttcacagcctccctccctcctggcataggccaagcctgtggttcaatgtagcttttgaatatatcatcatcatcatcatcatcatcatcatcatcattatcatcacaacctgtccacatagtcaatttaatttgacaaacactgattcagcacctcttgggtgccagaccctggctggcaaattaaaccgaaggacatctatgtgtttaaatagctatcatggaaaaaaaaaaa

SEQ ID NO: 821 - DNA, 184 bp, dog
cgacgctgcagtgaggttgtatttgatctgctttctttcatgcaggtgacgtaggcggacagcttctgtgtcatgagataatctgtgatcatctatgccagtggttgcatagtgtctggttaaaaagggccaatggttacaggtttagagccagagtctctaggtagctttagaaaaaaaaaaa

SEQ ID NO: 822 - DNA, 187 bp, dog
cgacgctgtcagaaatactagctcacctttcatttgagcaaaataatacaaacttaaaaaaataataataatagtaatggtagtaaggtgttgaatttctagttttcttaatttttctttcagtttgaatgtttaaaaattattcaacgtttcagaacttaataaatacatcctcagaaaaaaaaaa

SEQ ID NO: 823 - DNA, 401 bp, dog
cgacgctaaaccgctgagccacctgggctgccccatatttaatttaaaactgttaggcaggatgatttgtacatagttattatctaacaaagcagtaactctttcaaattataatacaagcactcagtgagaaacatatttagcttaacctaaatcccacaagccacatgaaaactggattcataaaaataaacctatgtttctatatgaggggataaaaaggaaagaagtttttctgggatgagtgtagaaagaaggggtgaaaaataaaatataataccatctaaatttgatgtatttaaacaaacaaacaaataaataaatttgatgtatttgaaattttaaaattcaaactatgctgacagtttaaaatgcataccttcttgcttggaaaaaaaaaa

SEQ ID NO: 824 - DNA, 306 bp, dog
cgacgctagaggaagaagaccagctaataggtcctacaatgcagtggttcatagtttttcgcccacagacccgacagatgtgaggattaatttagctgttggagaaccagtcctcttagtaatactgtgctcatggtaacagaggttttcatcacagtgcagcaggtgggaagatgtctcatgacttaagatctcatattacttttaaggaattgttaaggcttaatgctccaaaagcctgaaatccctttgaaattggtaggaatgaaaatggaactgaaagttaactattgggaaaaaaaaaaa

SEQ ID NO: 825 - DNA, 165 bp, dog
cagcagcagctatggtgagtcagcctcttccagaagagtattcatcacatggtatgaccactgagttaatgtacctctgacagctcagctcacagaccttggctggatcctggaatgattcaagcaaagtaacaacttagatcgttggacctggaaaaaaaaaaa

SEQ ID NO: 826 - DNA, 194 bp, dog
cagcagcaggtgatacatagcaaatatatttataatctggagtccatgtcataatgacctaataaaactgagctggaataaatgcttgcctaaataagaaataaggatttgtatctcagctcttatagtaactcaggcactttgcttcttgacatcctaaaatttctgaatttccctcatttgaaaaaaaaaaa

SEQ ID NO: 827 - DNA, 252 bp, dog
gctgctccaaaataaagcttcacatttaaccagctcttataaacaacaataaaacattaaatagctttgcaaagtcataggtatgatttatcgtcgattttgctcttttaagcatttcacagggtagattgaatgacctaagagttgaaataatgggtctaaactgcaaattcaaagtccatttaaatacatacaccaaggtctacattctcactcaaatatacgaactgccctttaaaattgaaaaaaaaa

SEQ ID NO: 828 - DNA, 483 bp, dog
gctgctcccacaacacaaaggggcattgaaacgcccctttccattggatctcttctctgggctccccactctgccctccccagcagctcctcatacacacattcagacactctcctgggactcattgtcttcccagtttgatttctttctctttctgtcagtatccaccctgttttggtaaccatggcaataggtgaaacacaatctcaatatttgctcgggcctctgtcatccagcccagcacgcgcattgccgggtcttgtttttgtgtttgtttaatgttcccaagcctgaagtcagatgcatctgggcaaggacaccgcacatggtccggttcggaacactccctctcagacagttttcaggcacgtcttcttgtgggtctgtgtacgtgtacgtgtgcgtgtgtccctgtctgctttggaacgtcatgcaaaaaagtttagcttgtgtcagaatagccaaggaagggaaaaaaaaaaa

SEQ ID NO: 829 - DNA, 266 bp, dog
gttatagataaaaagaagttcggaggaaaaaatatgtaacaatgacaaacgatgagcttgggattggattagtaattaccaacactagatattggcagataatagaacaattccttcagagttttgagagcatgccacttcaaggtagaattctgtatcaagccaaacaattaagtttgaaataaacccattctctgaaatgtaaggaatgtgaacttactttcagatataattgacagaaagggaatgtgaatgaaaaaaaaaaa

SEQ ID NO: 830 - DNA, 167 bp, dog
ttattcgcaaataacaaacacaactgtagagcatgagaatatcataaaggaaaaataagaatgttgaaaagttcttcctgttttgtctttaaatatacaacagcttgagtgctatctttcttggcactcccctcattcccacaaatgggattatagaaaaaaaaaaa

SEQ ID NO: 831 - DNA, 218 bp, dog
ttattcgagagggagagagaatgcatgtgcaagcatgagcagagcggaaggagagcatgaaataaactctctgctgagcagggagctcaacatagggcttgatcccagcatcacgacctgagctaaaggcagatgccaaatcaactgggccacccaggcacccctatatttcttggtcataagaaaaagaaatgaaatcagtctgtgaaaaaaaaaaa

SEQ ID NO: 832 - DNA, 324 bp, dog
ttattcgcacattagtttttgcagtttacacccaggatgtctcagagccgcagaaaggaccttcactgaatcagcttccataacagtgtttgtcacagccaggacttccaaattctcatgggtcctaaccacggagcagaagtcttgccaccagagaaaacactgattgctgcttcctggtctgtgtgcaagggagaaaagagaacatggcttgtcatcagagattaaacttgagaaaatccacttggaaactcagggctggtgttcctgaccctggttgtgatcacaatgatccagtaagactcccccattgaaaaaaaaaaa

SEQ ID NO: 833 - DNA, 288 bp, dog
ttattcgggaagtttcagacgtgtatttttctgattctgtaagcaaagtacaagccacagaaagtaaaagagaagagcaagtagaactggcttctgaaaaagaatatagtaaaactgatgcagatagttttgtagagagaatgtcaccgagtacttgctgtggtgaaaataatcaagaagactatgatctttcagatactgtgccatttcaaaatgaaaaatcttcacctggtgaaacattagaagaaagagccacagtaaagaaaaaagcctttggaaaaaaaaaaa

SEQ ID NO: 834 - DNA, 416 bp, dog
ttattcgtatggataacaatgcagcagctattaaagccctcgagctttataagattaatgcaaaactctgtgatcctcatccctccaagaaaggagcaagttcagcttaccttgaaaactcgaaaggtgcccctaacaactcctgctctgacataaaaatgaacaagaaggaaggacaaggagcaagagatgattttagagatgtgacttacctaacagaagagacggtgtatgaaattcttgaattatgtagagagagagaggattattcccctttaatccgtgttattggaagagttttttctagtgctgaggcattggtacagagctttcggaaagtcaaacaacacaccaaggaagaactgaaatctcttcaaggaaaggatgaagacaaggatgaagatgaaaaaaaaaaa

SEQ ID NO: 835 - DNA, 442 bp, dog
ttattcgtaatagccggcaactaggaacaatccaaatgcccatcaacgtaagaaagaataaatgaattgtgatgtatttattcagtgaggaaactatttagcagtaaaaaaaagtgtgaactaatacgacaacataatgagtccaataagtcagacaaaaagggtacaaatggtgattgtatgattctgtagatactgaaggcccataacaggcaaaactagttatttgttagaaacagaacagtggtcatctatttgatgtgtaggaggcttaaggggattttttggagtcatgaaaatgttccatatcttgattgtcatgttggttatgcagatgtgtacatttgtcagaatttgttgaattttatatttaagatcagtatattattgtatgtaaagtatagctcagcaaaataaatatggaaagcgggaaaaaaaaaaa

SEQ ID NO: 836 - DNA, 185 bp, dog
caagtttcaagcttcaagtttcaaagattaagagaaaatcctgaaagcaactccagagaagaggttcttaacctacaggggcaggaacattggactgccctcagacctctccacagagacctgggaggcaataagggccggcatgatatattgagggtactaaatgagatgatgaaaaaaaaaaa

SEQ ID NO: 837 - DNA, 220 bp, dog
caagtttgcacaattaataaagaaatgtggggccattggtgtaaacaagccatctcattagaaccagaacttcctatttgtctaatttcttggatagataatgccagttaattactttatgaatatggtatttttctccaaatcacctctatgtgtctaaaatggttctttctgtaaatcaatgagaaaataattgaaccgaaaaatggaaaaaaaaaaa

SEQ ID NO: 838 - DNA, 238 bp, dog
caagtttggacactcagcatcttttaactaccttacttttaagacatctcatctctaagcataaaatgacaaccacaagggaaattaaaagtatttaaggttattttgtcaaaagagaaaatttaatatgattttttgaaagctatccaagttgatgaaaaactataccaaacatagcaactacatgtcctatatattactggagagagcagaaaaagaaaacatggaaaaaaaaaaa

SEQ ID NO: 839 - DNA, 251 bp, dog
caagtttagggatgttttattgaaaagaatataggagaagggaaagccttccttatggtagaattcaaattaataaatatagaaagaacgatggaaataaaaaatccaccatcaggcaaagctattgttgtagcaagtatcatcagcgtatgctaaaattagtggtgaaaagtatgacaagaaagaggatactaatatactctcagagtatctctctactagatacatcaattctaaaggaaaaaaaaaaa

SEQ ID NO: 840 - DNA, 148 bp, dog
cctgcaatgcccaggcgtgttcttaacaagagccacacttcctaagctaatttctttcttgccgaaggcctcagttcattggcctcagacataattagaatgacactgggggacacagtcgttctttcgtcattttgaaaaaaaaaaa

SEQ ID NO: 841 - DNA, 218 bp, dog
cctgcaatggttatcattttatattgaagctggggaaatccttttgtctagaataaaagtgcctccaatcataacagactgtacatagaatgagcattgtaagggttatgcaatgagtcgcatttttaaaaaacacttgtataacttatttcaggactattagttaactcttgtccaaaaacgtccaagatacatttgccaacttagaaaaaaaaaaa

SEQ ID NO: 842 - DNA, 380 bp, dog
cctgcaacactccttacatccttcatgagaactcaggaataacaagacttcaaagaagaggatctgtagaggtatacgagcagtgctacagaggacacagaaaatggcaaggaaaacaccactggtggaagacaacaacaataattacacagtgcattagttttgtgtcctatgaatgaactctaacgtcatttcctcaaaatcatacctcatccatttttaacctgatagaatgtactttacaccagagaaacagaaagaacatgttaaattacaaatgccctttgagaacatcggcgtttagtgggttacacagttccctcttccttccatctaccatactggtttgagtcaatgctgccaccgttgaaaaaaaaaaa

SEQ ID NO: 843 - DNA, 420 bp, dog
cctgcaatagttgaaatagacacaggtgaaaaataaattcagaaatatgaaaataaaaagttaaatatcttctacacctacttttaaggccagagatccataccttctatatattaaaataaacataggatgtctttcaaggacacaagtatagcaagaccagacaatgagttaaatatatttttatgactttgtcgcctccgattagataaaaaaaattactaaattcaccaacatactcattttcaggaaatacttattaaaagtcttacctttcacaaaagtgtatcatgttcaaatgtataaaattaaactttatttttattttttattcaggagtttgaaagacaccaaagtgagagttagacaaaccaggttccagttcatgttttactactaattaagcctgaaaaaaaaaaa

SEQ ID NO: 844 - DNA, 264 bp, dog
ggtgaactcagcacaattaaatgcttctccgcaaactgcaacgtagttctcattagagaaatgacccctaattagtttgcattcttttttgcaagggaaatactagacagttttaaaccttatatttttcaaccggatcctgaaaattggaggtttttcccttcttacaataaaagaatattgtagaaaactcagcatagtgtgatttgatacgttaagatgagcttaagtgcaaggcatttgttactttcagaaaaaaaaaaa

SEQ ID NO: 845 - DNA, 478 bp, dog
ggtgaacacagatttactttgaagatttcactgaatctttttgacttgtaagccactcatggcacaagaaagcaagtttaccgtgcaaaccttagccagatactagccacaatgaaggaacctcaacaaatttagatgtgccgtgcagataattcccttgaaagttcagataattgcctaaagcttatttaaatctgtggaaagactttaccctcttcttcacctcatctcatcttttcttctttcttccataatcctccccaccccactctgatctttttgtcattctccagatcaccctactttaaatctcctggttttatcctgagtttccacctcacttttgaaaagaccctcttgggctggcacattccttaagagagtaatgggtttccttgtcatgcattgcttatgcatccagcgttttcaagagtcaggtctttggaaagtttgttagtaggtttctagaaaaaaaaaa

SEQ ID NO: 846 - DNA, 150 bp, dog
cgtacgtttcatgtctgtacagattatttaaatcatagaaataaaaaatgttctctgcttgctaccaaaggacaaactcttggaaatgaaaactttctgctttccttcctccaaagaatattaataggcgacagtgggagaaaaaaaaaa

SEQ ID NO: 847 - DNA, 345 bp, dog
cgtacgttgaaggacacaaccagtggagttgctaccttttgcgagcttgaaatcatggcaggtccagaaactgatgcccaattccatttcactggtatcaaaaaatatttcaactcttacactctcacaggtagaatgaattgtgtatcggccacatacggaggcattgctttgatgattttatacttcaaattaaggtctaaaaaaacaccagctgtgaaagcaacataaatggactttaacttggacctcatctgttaaattcccatgcttggaaaagctaatgtcaactcatcatgtgatactcaatttgtacaataaattatgaacctggaaaaaaaaaaa

SEQ ID NO: 848 - DNA, 602 bp, dog
cgtacgtggttatgtggaaacagatggagcagacatactggcaggcgaatcccttcagggccgtagctgaacccggcattcagctcaaggctgtgaagtcctccacaggccccggggagcagctgcggaatgcactctggcacacaggggacacagcatcacaggtgcggctgctgtggaaggacccccgcaacgtgggttggaaggacaagacatcctaccgctggttcctgcagcatcggccccaagtgggctacatcagagtgcggttctacgagggtcctgagctggtggccgacagcaacgtggtcctggacacaaccatgcggggtggccgcctgggggtcttttgcttctcccaagagaacatcatctgggccaatctgcgctaccggtgcaatgacaccataccagaggactacgagactcagaggcttctgcaggcctagggatgggggtggggacccattgctggaagatggcaccatcgtggctaccctcactgcaacaaacagggagcttggcacccggctccaagaggtagctgccctagaggggctcagaaaggacaaaataaagtgtgtgtggtggaaaaaaaaaaa

SEQ ID NO: 849 - DNA, 196 bp, dog
agcagcaggatagtaagcagcttgtcaaaaaatgaacaaaggatttgagcagacatttctctgaagaggctatacaaatggccaaaaagtacaagaaaaaaatgtttaaggtcattaatcattaaggaaatgcaaatcaaaaccatcagatatcagtttgcacctggtaggataattataattggaaaaaaaaaaa

SEQ ID NO: 850 - DNA, 403 bp, dog
agcagcagcagcagagatgataacatgtttcagattgggaaaatgaggtacgtcagtgttcgggactttaaagggaaagtcctaattgatattagagaatattggatggatccagaaggtgaaatgaaacctggaagaaaaggtatttctttaaatcctgagcaatggagccagctgaaggaacagatttctgacattgatgatgcagtaagaaaactgtaaaatcagagccatataaaacctgtactgttctagttgttttaatctgtctttttacattggcttttgttttctaaacgttgttttccaagctattgtatatttggattgcagaacaatttgtaagattgaatactttttttttatgtgcattattgaaagtgttctgagtgaaaaaaaaaaa

SEQ ID NO: 851 - DNA, 285 bp, dog
gacctttggggggagtaatactgttagagtgtatcctgtggtactaataatctgctttggctttatttgaaatgactagagagccattgagtagggcatttggaagaggaaggaatgtccttttctttggagtggttggtaatcagagtcttgggtaccaagaaaacagtacattctagaggagtattcaaaggcagacatcttctgttttcaagggtaagttggaaattgttataaaatattgagttgcacggagcataagaaaatgtacaggaaaaaaaaaaa

SEQ ID NO: 852 - DNA, 145 bp, dog
gacctttgagaatacgcactaacataaatgagatttaaaagatactgtcgattttgtctgtatttttacctgtatcctaaattaggaagtttgagtggattgcatgaaaaaggtgtcataggtatatattatggaaaaaaaaaaa

SEQ ID NO: 853 - DNA, 154 bp, dog
tgagactgcattgaagaaagatgaaaacaccagctaattaccttccaagtttttgtttgtaaactcagtttacaattttctgtagtcatcagtaaggatgggaacattttagtgaagttaggagaccttttaagaaaaaaaagaaaaaaaaaaa

SEQ ID NO: 854 - DNA, 172 bp, dog
tgagactgtaagcaaaccattgtcaagaggactctaggactttttcttctgattcgctgttgagaacatcagttacgcaaatgtataataagtggagtttaaaatattttcagtgagcagtatatttttacatatcaatgagatatgtatagtaaaaccggaaaaaaaaaaa

SEQ ID NO: 855 - DNA, 151 bp, dog
tgagactagctgcttgaggtggatgtacaaaggataggcggtattttattgctgtaatattgtacgatactgtaactatacgttgtcacttactgtaaatgtaccatggttttattaacaataaacacttgttaacagcgaaaaaaaaaaa

SEQ ID NO: 856 - DNA, 171 bp, dog
tgagactaagaataataaagggctctcatggtgatgtgaagtgttttattatgacaataatgtgagatattaactctcattttctttgtgaccctccgtgggatcaccgatgcttcaccgaagacttcaccatgtgaaactaacatttgagcaaactaggaaaaaaaaaaa

SEQ ID NO: 857 - DNA, 294 bp, dog
tgagactttgtacattggttttcctgccattttcttttttctctcgtctgtattggtttttgatcgtggcctggtgttgggaagagcattaagccaagagctgtctctttgatctgtttctgttaaagtgaactggtgtccttgcatttcatttgtgcttccgatttgcttttgttgagacttcccgtcctttttttttctttttttttttttattttgaggaaaagtcaaattcattgtttatttttatattatttttaagttatctgaacaaatacttttgaaaaaaaaaaa

SEQ ID NO: 858 - DNA, 173 bp, dog
tagtccatgatactatacttgtgagagcatatccagatgctgtgttctctatttaaaacagtattgtccaatcagaaatgtgtggcccttcatttatggatattgagtatatgtaatgcagtgctagcccaatattttcaataaaggaatttactcttccagaaaaaaaaaaa

SEQ ID NO: 859 - DNA, 280 bp, dog
tcctggaataattctattcttttaccaataatattttttgcccaccctcctataaaaacctttcattttatacaatttctcacagaagccctctgtgtgctagatgggttattgcctaattcatgaatcatttaataaaaccaagtagatctttaaagattattcagttgaatttttgttatttagtacattttactatataaattgtctctggacaatatgttacagtctttctacacaaaaataatattaagaaattatgaaatttgaaaaaaaaaaa

SEQ ID NO: 860 - DNA, 449 bp, dog
tcctggaaggccacagactaccaaaaatggaaaggggaagaaatagaaaacccgaacgggccgaaaaccagggaggaatttgaagcagtcatcagaaacctcccaagacacgcaagtccagggccagatggcttcccaggggaattctatcaaacctttaaagaagaaaccatacctattctactacatctgtttcgaaagacaggaagagatggagtacttccaaattcgttcttgaggccagcatcactttatttctaaaaccagaccaagaccccaccgaaaaggagaattagagaccaatatccctgatgaacatggatgcaaaagttctcaacaagacgctggccaatagcatccaacagtacattaagaaaactaactgttcaccatgagcaaatatgattcatcactgggacacaatgctggttcaactcgaaaaaaaaaaa

SEQ ID NO: 861 - DNA, 191 bp, dog
ttgatccaaaacaatgtaattctgatctgacttgatcgtgaacataaaagtaattgctcttgaactgccttgcatagcgaataacctctgagtaaaataatattaaaccaattctcaagagatagagactttggacacttatgtatttagcaagataaggggaacagaggaagaacacagaaaaaaaaaaa

SEQ ID NO: 862 - DNA, 206 bp, dog
ttgatccagcaagcaacaactgttaaaaacaaggatatcagaaaatttttggatggtatctatgtttctgaaaaaggaacagttcagcaggctgatgaataagctctgagttgtccagcaacagaaacagcaagatgccagatgatttttcagacttatttgtgataccttaagaatgcaataaaaactacactgaaaaaaaaaaa

SEQ ID NO: 863 - DNA, 235 bp, dog
ttgatccacagaagtgtgagtggagactaatgaggacagtgatagaaaaagtaaatttggggctaatgatcagctaagggggatagactaattttccaccccataggactgtcttgggatgctttccttaaaaaaaagaaagaaaagaaaaaaagaaaagaaagaaaaaaaagaaaagaaaaggaaaagaaaagaaaaggaaaaaaaagaaaagaaaagaaaggaaaaaaaaaaa

SEQ ID NO: 864 - DNA, 269 bp, dog
ttgatccagccatttcattcctcagcattcacccaagagaaatgataatatttgctcacataaagactggtacataaatgttcagagcaacttgattcacaataactaaacactagaaatcatctgaattcccatcaacaggtaaatccatagacaaattgtattatgtcaatgtaatgggatattactcaacaataaaaatgagtaaacccctgatacacataacaacataggtgaatcttaaaagcacactacatgaaaaaaaaaaa

SEQ ID NO: 865 - DNA, 320 bp, dog
ttgatcctcaagtgttgaatattctttttctttgggaatgggtttggggttttttgtttcttgttgtttttcttttttattcctgaagcttaccagatatgaatggctaatattccattgttctgcttattgtaatggtggatgctttaagaaaaaaaaagtgtaatttgctaagaataattcatgatctgtttatgcgataactcctttttgttacgatttttttaaaaaaagctatttttgttaatgtaaagtaaatatttcagagcaaattttttaaacttattgcactaaatacaggctctgtacgaaaaaaaaaa

SEQ ID NO: 866 - DNA, 374 bp, dog
ttgatccctactgagcattgtgacagggcatgacctttaggcttctggaagacagtctgtagcttatcctattttttatgaaccagaatgtattacttgttaatatgcattaggtgaatataagtaagtattcctctatacctttttgtagaaactcagaatttaagaggaaacgcatatactggaaaaaagatagaagagaaaacaaaagattgtgaactgtagttctcagggtcaaatcagacagtttatgtaactctttatacccaaagagttgggtacatgaggaggctgggccagttgattttaaatgtctgttcagttctgtaaccgagaatgtttatataatcctaaggaccactgaaaaaaaaaaa

SEQ ID NO: 867 - DNA, 249 bp, dog
tctctggattattggatgccatttgggaaaaatcacgaaaaatatcctggtaggtttcatcacctgcaggaaagtaaaataaagacacttttataatgcattccatgaaagtattaataaacaacattcattttttatggctagtaactatattataattaatcatattcaagttttgctcagatgagcatttttggaagaaaaaggactaatataaatgctggaaaagcatatattgaaaaaaaaaaa

SEQ ID NO: 868 - DNA, 273 bp, dog
gttgtgcagcaagtgagggcccctgggtgagctgggagcacgtagaaaacacctgcccttagaaaggggcaaactctgtcaaaacttcctgcctgtgttttgaggtcaagctgctctgaagacctccatttttaactcaaagaaatattttatggttgatttagtaaaaatacattaaatttagaactgaattgtgtttatattttttcaggtaatgcttctcacattcagtttttagtaattgcttatgcctagctactagaaaaaaaaaaa

SEQ ID NO: 869 - DNA, 376 bp, dog
gttgtgcaaacaggaaattgctgtgtagacttgtagagcaagaagtgaagttgttaagattaagcaaagcaagcactttacctcgagggagtccgtcggatgtcagaaccaaaaacatgtttctgaaactcaagcaattataacacgtggaaatttttgctgtatttagtataggcaaggagaggtaaactgagaataaatgggaaaaaaatagtagtcctttagaaaacattgttagcagatggtaaatttgtaagatgaacacaaaatccacaaaaatataagtcaactagataccacaagtggttaagtggtttttgcttgattgttttgagtgatgagaaagcgtctgtaaataccgctggaaaaaaaaaaa

SEQ ID NO: 870 - DNA, 147 bp, dog
agaggcaataatattatggttagcaatctccattttacttagtggagggttcaaaactaggtaatataaaatgaatttctggctagtaaatcttgttttccaattgattttaacttttaatgggatatgcacccagaaaaaaaaaaa

SEQ ID NO: 871 - DNA, 188 bp, dog
agaggcatcacaattccagacttcacattatattatgaagctgtagtaattaaaacactatgacactggcacaaaaataaacacatagatcaatggagcagagcagaaagcccagtaatgagtccataattatatggtcaactaatctttgacaaagcaggaaagaatatccaatggaaaaaaaaaaa

SEQ ID NO: 872 - DNA, 196 bp, dog
agaggcagtcatgaggattcggtgcacaaaaggtgggggcactattttttttttttttacatttacctagatgttacttttgataccagtaaatatgcatttttatctagtcttatttcataagttttggtcttctaacatattttacttaaactgatggaatatgcaattaagagtagagggggaaaaaaaaaaa

SEQ ID NO: 873 - DNA, 346 bp, dog
agaggcatgacccaatctttttaggtccaaggttttctctgtacagcgagtgggctgactttggtggttttcaagcttcctttcagctctgagattgtatgaaaatgatctacaaaggccgtttattgttgtctacataactcaagagtgaaggcagggcttctgttaacaatccagccctgtgcttcttcctccttcttatctctcctggtgcaataaaccattgttttcttgtttatcttccttttctcatgccacacgacattatttcagagagaatctcattctggcattctctatatcctctaatgtatgatgtgtttttgtgactagtgaaaaaaaaaaa

SEQ ID NO: 874 - DNA, 395 bp, dog
agaggcacaagagcaggcttgataaaatcattcggaaattgacagagggcgcagtggatgtaaattccttggttttgaacagcagctactccgagcggcaggttactgtgaactcaccttgcagctagatggctgcctcggacctggttttccacttgctggcgacaggatgcagtggcatgcgggcttttatcacagagcaatctgctcacctctgttgtagctgtcagaaggcaagaactctgctctccggaaggtttggctgagacttctgcatatgtacctcactatagatagacgcaggacaagacagatgctgcagcccgtttcccatttatagctgtcacttaccccactggagcttgttcctttcctctctacacgaaaaaaaaaaa

SEQ ID NO: 875 - DNA, 419 bp, dog
agaggcagtagctagggctaagaggattttgttgttgttgttgttgttgttgttgttgttgttgtttctaatttagttagatgggagaaatcgcaaaatgttcctggaaatgatccagtaaagaggaagaaatgatgatgtaggagacgatggtgagaaatactgacaaaagcaagaaggggatagaggctagtgtgtaagggatggttattcttagatgataggatgggcagctcttccagagcaaagaggagggaagaccgactcctttggcagataaacaggtgcatgtggcattttccttccaattgccaaaactttgagttgatataaaggaagatcaaaaaatttggaactatgttgtcatataacataaaaacataataaaaaattcttgattttactgggaaaaaaaaaaa

SEQ ID NO: 876 - DNA, 522 bp, dog
agaggcagtggtgaggggtgggcatgctacttggtgttgggaaacatttaaggcttaagttgctggtgctgctagggtctatgcctatctctggggcctgaaatttgggggtttgatgagtttcacatagaacacaaaaaatgaccagagccctcacatgagagttggatctagacctctgtgtaaaactaggacctgaaaaggcacatgctgagtaaagagatgatctagaaaataacttcaccccacaggggccaaaaggacatgagcaaagtgtgtgcaactttctcggtcacaattttaaaggaaattgcttgctctgcacttcctctctccccttcctgagggcttgaattcaaatgtgttgctggtaaattggcttaggattgacctaggaaatggtggaacaataagttagaaagaaacagtaagttgtatgctgggcagccttgtcttcctgcctgcttcttctggactgtcaatataagagaaaaataaactatcttgtgtgaaaaaaaaaaa

SEQ ID NO: 877 - DNA, 170 bp, dog
accaggtgagaaaacaaaagagtcttatagagatcttgtttgtctccaaacttgtaaaaacacttcactagtcatttgaaaactgcaaaactattatacaagatttatataatgtctgcttttgaacactgttccttataaactgttaccataaatgtgaaaaaaaaaaa

SEQ ID NO: 878 - DNA, 145 bp, dog
cgacgcttcaactcctattgcaatacaaataagtaacattatctaacatataaagaaacatttgaagtgaactttagtgtggttgttcgttttatcctttacttgttttataattactgaaaaatgcttctattaaaaaaaaaaa

SEQ ID NO: 879 - DNA, 170 bp, dog
cgacgctaaaaactacaaaacattaatgagagaatttaaagattaaattaatggagagctatacttttctcatggattagaacatttaagattagtcatatgactcttctaaccaaatttatcaacatatccatacaatttcaattaaaactcccaactaaaaaaaaaaa

SEQ ID NO: 880 - DNA, 188 bp, dog
cgacgctgaggcataatccaataaaacagaatttaaacagatgacctgataggtgatgggtattaatgaaggcactcattgtgatgagcactggctgttgtatgtaagagatgaatcgctgaattctactccagaaaccaatattgtactgtgtgttaactgagtaaagtttagattaaaaaaaaaaa

SEQ ID NO: 881 - DNA, 193 bp, dog
cgacgctacggccacaagattggccccctttccccattcacaagtgcctaccgcaggaatgggatggcttttctggcctgctgatgggactgtgactgtaacaacaggaaaggcaatgttatattaaggtgatttctgttcccctctttggacaaaataaaatacaagtttaccttctctttaaaaaaaaaaa

SEQ ID NO: 882 - DNA, 359 bp, dog
cgacgctgactttgccttcagtcttctaatatccctgctcacatgcccaccatcagtcactgctcgtaccatataaggaggggttggagcacattgctctggcctcttgcagctttggtggtatctccatgatttccagggtcacatctaaacccttagcctgggcagccccggtggcttagcggtttagcgctgccttcagcccaggcatgatcctggagacccaggatcgagttccacgttgggctctctgcatggagcctgctcctccctcagcctgtgtctctgcctctctctctctctctctctctctctctgtgtctctcatgaataaataaataaaatctttaaaaaaaaaa

SEQ ID NO: 883 - DNA, 439 bp, dog
cgacgctcaggaggcttttagttcctgtgggagagaaataaatttccaaagacatcgcttggctcatatcactagagcagaggttttaactagttgccctggagctaaatgaagcccaaagttgaaattacttggaatgggtttagattttttttaattagttgccagcatctaaaaattgagaggtttgaaataaaattatagaaagctaggaggctctggaaaaatctttagggcaacccaggtggctcagcggtttagcgccgccttcaacccggagcctgatcctagagacccgggatcaagtcccacatcagactccctgcatggagcctgcttctccctctgcctgtgtctgtgcctctctctctctctctctctctctctctctctctctctctgtgtctctcatgaataaataaaatcttaaaaaaaaaaa

SEQ ID NO: 884 - DNA, 245 bp, dog
cgacgctgccctctatgggtttgaaaccaagtgtaattaaaagagcacatgtgtaatgattattacacaagataggaaatgatcaattccagaagaaaaatatacgtaaggtttatataaggatgaggctctttccagccttttattttacaggatggggtttggagaaataatttatattcaaccttttaaatagttaagaaaggatagagcaaacttagaaagctccagtctaaaaaaaaaaa

SEQ ID NO: 885 - DNA, 267 bp, dog
cgacgctaacccagtttcctttacactattcacgtagagccttcgaacaccatcttcttccacagaggaaagtgaaaaccctagaaaacacaaagacagaatggtagggctcacaccttctgaatgtttaccaaacaacaggaagtacctgctgtgaactacgtatgtttgatgtttttggttacagtttggagcgatggtttctccttgtttggattattttaaaaagcagaaaaatgtatttttggatgactctaaaaaaaaaaa

SEQ ID NO: 886 - DNA, 168 bp, dog
cagggcatgatcccggtccaaggattgagtccaatatcaggctccctgtgagtagcctgcttctctctgcctgtgtctctgcctcttctctgtgtctctcatgaataagtaaatctattaaaaaataaaataaaataaacttctttaaaaaaataataaaaaaaaaaa

SEQ ID NO: 887 - DNA, 267 bp, dog
cagggcacatcatcaaataaatttttactagtcaaaggaaaaataatcatcaaatttcacctaattgatggtcttttggggctgacactagtttacatatcaaaaatacttgggggctcagcagttgagcacctgccttcagcccagggtgtgattgaatcccacatcggcctccctgcatggaccctccttctctctctgcctatgtctctgcctctgtctctgtgtgtctctcatgagtaataaataaaatcttaaaaaaaaaaa

SEQ ID NO: 888 - DNA, 383 bp, dog
cagggcagacctgtgtgaaagctgtcttgtgatctattcttgagagattcttatttttctttatctgaacatctggattgagaaagcagtttttcttgctgtctccttctacaccagtagtttatttcttgttcccctgagaatagggtgtagatcccaagttctccagctgtctcctattagactccttaccttaggaagaccctaaattaacctcctattcatttgtcacaatgggagttggtattccctagaggttggcagcaaccctcaaagttgaaaccagctttggctctcagttatatggtaagattcttgatttagctttgtttaggttcagtatattcctttagttcactcagtggtagatgtaaaaaaaaaaa

SEQ ID NO: 889 - DNA, 323 bp, dog
cagcagccgctaattggtctccctctcctggaatgtggacagccttaccctgtgttccctgtcatttcagctgattatggttttcttttaaggatatgaatttcataatttccatagataaaaagtaacttagtatgtgtttcgaagagagtttgtaaacaggtagcccaagctacataaacactgcgctgttaacaggctaagcatggaaagatgccccttagctttcttgggcatatgactgtgcccctggatagaactctgcctatgtctctgcctctctctcggtctctcatgaataaataaaatattaaaaaaaaaaa

SEQ ID NO: 890 - DNA, 276 bp, dog
cagcagccactggtgaaaaagcctctagcaatttcttcctgattcccaaagccaattacacagactccaaagaggctctgacccaggagtaaagaaagcaagtcatctgggtttcccacaaacaggataaggaagtccagaaggggtggaatcaagcaagcccggaattactcacgtttttagaaagctacaaactttcaggagcttcccccctctttggaaggtgttatctttctctaatataaacaaaaataaaacatgaactaaaaaaaaaaa

SEQ ID NO: 891 - DNA, 331 bp, dog
cagcagcacgtgttagatcccagaattagttcctaaaggtttgagtaatgatattttatgctttgtgtacagtttaagtcttcaacccttggggcaatacagaattagcagttaaatagattcaaaataaacaatgatagcccagtgcttttacagtcaaatataacagagcttgaatttgtgaccacctggaatttttgtgtttcaagttttaaacagtgaaacagagtgtatacactgggaggtgagatatttgtgtttcataagtgcaaaatttagttaaacataaaatatgtttgtctcattttatgattgttgttaaaaaaaaaaa

SEQ ID NO: 892 - DNA, 400 bp, dog
cagcagcatacaagttactgtaggcgcagtcatggaaaggtgattaactggacccatccattgttggagttttctaggcagttgggacatgaatagaaatgagaaatgctgatatcaaccaaagagatggttcccgaagactgtaagttggatgaggaggaaaatgaaggaggaggtaagtggatctgaagcatcaatgagaatgaagccccggctattacactggagattcctgagaaagtgagtcccaaggatagaaagctacaatcaaagagtatgatatttaattagtgattttggaggcaggaagtttctggtgaagtcaaggctgttgtaataaggggagggaaaattatgctgatatactttgtatttagtcaagccgtgtaaaaaaaaaaaa

SEQ ID NO: 893 - DNA, 231 bp, dog
gctgctccagtcgctgataatcaaatagttgcacctttctgtaacatttctctgctccctttgtggctggaattgttccttaagttcaaagagcccttccattcacagcggggtagatatttgctcataaaacaaagactttagaagcataaatctgcaaatgggagcttgaatgagatggtactcatacagtggttagttcaggagttgataccactttaaaaaaaaaaa

SEQ ID NO: 894 - DNA, 248 bp, dog
gctgctccttctacaaaatccctttactcccatacttcttttatgtagttagtgtatactcttcattcaaacctcactcacatgttaccctgcccagggaaacttctttaactccatagcctaggtgagggggaccttcattatgtttccataaatccagttatggcttcttctgtactgtatgaccttttttctttttaaccacattgtctatattaccaacaaagagtgcactttaaaaaaaaaaa

SEQ ID NO: 895 - DNA, 222 bp, dog
acgatgcacaggtttatttctggattctccattcttttgcattggtctacttggttgtccttatgcagataccagggtgttttgattactgtagttttgtactaagttttaaaatcgggaagttgagtcttccaactttgtttatcaagattgctgttcagccttcttgaaatacaatatgaattttaagatcttcttttctatttcttttaaaaaaaaaaa

SEQ ID NO: 896 - DNA, 154 bp, dog
acgatgcagaattaatttaagaacagccacaagatatctttataaaattccttaattgaaaaccaatcaaattctcaacgagttattctatattttccacactttcccttcccccatacattttaatatctaaaacgagaattaaaaaaaaaaa

SEQ ID NO: 897 - DNA, 162 bp, dog
gccatggtaaagacactcaatgctttaatacatacttgagtctcatgcataagagttacctagttatttttctgaaggtttcctcccagttttgttgtggaagcttccaagcttccatagagatataggcaccaaaaaacaatgtgggtttaaaaaaaaaaa

SEQ ID NO: 898 - DNA, 231 bp, dog
tcctggacaatagatgaatgagcagtagctttagtttatatgtagatatagttggcaccgtgtatgtatatactctggactacttagaagtaggtttttgagtatgacaaaagtcaaactgagttgtaatatattttggggagtcagttcactacatattgtgactgtaaacattgtaaatgttttgttttctcctaataaaatttttggggaaagggttaaaaaaaaaaa

SEQ ID NO: 899 - DNA, 317 bp, dog
tcctggataaagaaaagcaggggaatttatcaccactagacgtgccttgcatgaattgctaaatccttcaagttgaaacaaaaggacattagattataagagaaaaatctggggatccctgggtggcgcagcggtttggcgcccgcctttggcccagggcgcgattctggagacccgggatcgaatcccacatcgggctcccagtgcatggagcctgcttcttcctctgcctatgtctctgcctctctctctctctctgtgactatcataaataaataaaaatttaaaaaaattaaaaaaaactttaaaaaaaaaaa

SEQ ID NO: 900 - DNA, 327 bp, dog
tcctggaatactggttgcactgtactgctgtctcaggtcggggagataatgtcagatttcaatatcttcatttagctcaaacgcgatcatttatggcaactgtgccttctagtttatcacagaaatttagaaccattgtttgatttcagtgttgatgtgtttattcattattgatgtattcattttcatcactgtataggagattggttttaaaagtctgcacttacagcatggtgcatttcagtacacttgcatgaagctttctaagaagaaaaaaaagacaaacttaatgtacagtcttaaacatgtgttggataaaaaaaaaaa

SEQ ID NO: 901 - DNA, 530 bp, dog
tcctggagtggggggtgggggtggggcaacccatggcattgactaaatgaatatctggaaatgccagctctagaatgtggggactgggagaatgataaaatcattaacagagatagggaagtcagtcaaaaggaaaggctggaatggaagggaagatgatcttgaggaaatgcctagacaaagaaggaaagtgtcgagaaagagatagggagtaagaaatcaagggaaagagggcatgacatcaacatctattgaaggaaagtgagtggggatgagcttgaggtggccactgaatttgttcattaggagaaggttgttggcaaaccttgggagactggtttcagtggagacctaggtgcagaaggacattgagaagagcggaaaagaatgagcatagacagtagggtatagctctttgaagaagtgtgattgataatgtgtgtgtgtgtgtgtttttagtaaagttttactgataaagtaagggataaaagtaatgaagaaaatgttgtcaactatactaaaaaaaaaaa

SEQ ID NO: 902 - DNA, 531 bp, dog
gttgtgcctttgagatgtggccggtgcaacagaggaactccattttacattttatttacttttaagaaatatatgtatttacttttaatcattttaaactgctacttgtggctcgtggttaccatatggaaatcacaacgtagaactttctgactccccagtatgttcacgtttaactggatcatgctgctatttagatctagttcgctgttttttttttttcttttttttctttctttttttttttttttttttttttaccaccagaagatgcttagattccaccttctaatggaagttaaatcctgagttagctatagctcagttttgcttttataccttgagtggataaaatgaacacttttttttttaatgcttacgtaacatagtttaaactgatggacagaaatttaaatgacattttcttgtttggaattgctggaaaggcagagcatgtggattattttagcataataaaggagtgtaaacaggcaatatgaaatatcattgatgggaggctaaaaaaaaaaa

SEQ ID NO: 903 - DNA, 222 bp, dog
accaggtaccacagaggctttactatatacaaatatgtgtgttaaatcctcataaaactctgcaaagtacatgagtattattgccatttgaatagcctatgcagggaaaaaaacacttaaactctaattcaataggtgcaggctgcttctccctctgcctgtgtctctgcctctctgtgtgtgtctctcatgaataaataaataaaatcttaaaaaaaaaaa

SEQ ID NO: 904 - DNA, 278 bp, dog
accaggtgtgtgactgtagtcaagctacttaacctcttattgctttaattttcatcacagaaattctattaccaatttacaggtagtttgaaggattacattaaatgagtgaaaaaagaattttccacaatatctggcatatgtgcttaataaatggttttcaagtctttgaaaaaaccttgtttctgagtaaagggattacagataatttaaaatttcttattttctaatttatagttgctctacaatagttatgttttttgagttaaaaaaaaaaa

SEQ ID NO: 905 - DNA, 531 bp, dog
accaggtgaaagaggaacgtaattatgcaagaattattcatgcattcaaaacaatttatgcaaatgaaggtggttttcttggattttacagaggcctgatgcctactatgctaggaatggctccaaatgcaagtgtttcatttttatcttttggtactttaaagagtattaggctttcctgtgctcctactctttttggcagaccttcatcagataatcctaatgtcttattttttaaaaactgatataaatttactttgtggtgatgttgctggagcaattgcacagatcatatcctatccatttgatgtaattcattggcaaagataattaggaactattcttccagaatctgaagagtatcttatcatgcgggagactattaagtatgtccatggacaccatggaatttgagaaggattatattgtagtttatttcttaattacatttgctatattccatctcaaacagtggcttttacagcatatgactaggaagcaggtttttgttacctcaactaaaaaaaaaaa

SEQ ID NO: 906 - DNA, 421 bp, dog
accaggtctatgatctgaggcaattaacttgacccaaatctcaaaagcgtcatcactataatgggaatatatatcatgggaaggcctgcctcataaagttgttactgtctgtccaacatttaattaattagtatgtggtaaacatccaggaaatcgtagtctccataattattattcactactgagagacctttatttttttattttttatttttttactgagagacctttaatgagataaggcagagaaacatgaacctttccgagactcatctaccaatatataaaaataattcagtagaatgcataactgacctttagcagtgtatgttgcatggaggaaggctagcaattctgggtttcattggaaagctattcactgtttctgatactaacaacttcttatactgaaaaaaaaaaa

SEQ ID NO: 907 - DNA, 383 bp, dog
accaggtctaccatttctgactgaggctccacccactgcctcaccacccacagtctttccttctctacctttccctctggagaatctagaaactgggaagccaggcacaggtatagcagcagtgaacaaagatggctcaagttttttgcatccacgtccagctttctagaatgaatggtacagtccaatgtgttgcctcccacaatgggaggcttttttgttttgttttaaggacttgcatttcccatcatctttctttatattttagaatgctggactaaagaattcattaatattcaatgaaggataacatttttttttaggatcatgttaattgtttaatgtatttgacttctgtcccttcctccttggaaaaaaaaaaa

SEQ ID NO: 908 - DNA, 226 bp, dog
accaggtgacccatatttaaatcttttgactagatttttgataactgaagattggttcctaacatgcaattagagtcaaagtgcagaatcattgtgactgctcttgaaacctacggttgccctcagaaagattataccgattcaccatcccgtcatcagttttatgattacctgtgttagcattattgtttttaaaaatctttgctaattgcacgaaaaaaaaaaa

SEQ ID NO: 909 - DNA, 355 bp, dog
tcctggacacgtgggtctcggttctcgggccccattggatgtgaaacagtgaaggatggctggtgcatggcttgtaaaggaaaagtgaccatctgccaagggtgagcactgcgttttatactgctctttgtccttgcacttggggcatcctgtgtctgcttctctaaaggtcttctctttctcttttccagttctccaggcctggtccttggactgataccttcgccctgcctgttttacacctctttcttcatatccatctcctctctctgcccattcttgtaagtcattgtctgcaggtttctgaaataagatggtttatttatttatttaagtaatctctgaaaaaaaaaaa

SEQ ID NO: 910 - DNA, 271 bp, dog
tcctggaatcccagaactagattagctgtccctaataaatgcatcctgcacatatcttaataagcctaatgctttaagttattagagctaattgatactatatttctgaatagaatgtaagttacctaaggacgtggatttgatctgcactcactgttgtgtagctagtgcctagcactgtgcttttcacataataaatggagtgagtggatgtagagttggaagataaactatttcaaaaaggaattgggaagcacctggaaaaaaaaaa

SEQ ID NO: 911 - DNA, 263 bp, dog
cttgccatggtagtgagaaagcgttcataggcagtacatgaaggaatgagcatgactgtgccccaatataactttatttgtggacacttgaatttgaattttacatcattttcacatgtcagaaaatactattattttcccctttgtaaccatttaaaatgtaaagtttgttctttatatatcaggagcctgtacaaaaagccatcaggctggatttttggcctacaaactaatttaccaaccctggattagaaaaaaaaaaa

SEQ ID NO: 912 - DNA, 133 bp, dog; identical to SEQ ID NO: 259

SEQ ID NO: 913 - DNA, 449 bp, dog
acgttagccagatctctaaaatttttcttaaaataatagctaggtgttttctatctgtcatagtagggctaagtgctttacttgcattatctaatttaataccacagccagtgaggcatactgttttcatcctcattttacaaggttagaaactgaggcctggaaaggccccaaaacacagagttcataaagcgtaaagctaggatttgaactccattctgacactaaagcctgttctcttgaagattattctgtggtattgcatttggtgtcagttatctataaagtaaccttggccttttgtgtttatatgtgtgtgttttgttttgttttgctttaattagagacccatctattttggatagtttagatctgaatgaagatgaacgggaagtacttattaacaatattaataggcgtttgacaccacaagctgtcaaaaaaaaaaa

SEQ ID NO: 914 - DNA, 295 bp, dog
acgttagacctatagaaaccgggagattgaaagtcaggggatggaaaaccatctatcacgctaatggttatgaaaagaaagctggagaacccatacttatatcagactaactagatttgaaaccaaacactgggggacaccttgtggctcagtgcttgagcatctgccttcggctcagggtgtgatcctgggatcccaggatcgagtcccatattggcatccctttggggagcctgtctctccctctgcctatgtttctgcctctacttctctttgtatctctcaaaaaaaaaaa

SEQ ID NO: 915 - DNA, 217 bp, dog
atgaagggactaagaccaaaagtcataaattatttcagagaaacaaacccaatgatgaaatggaataacactgaatatcaagaaaaatgtatgtctatatgtaatttcatataacttgtgaaaaaatagggtatttaattgaagaggagagaaacgaaaatgataccctagagcacttatcatagacatgaactccatgattctacaaaaaaaaaaa

SEQ ID NO: 916 - DNA, 344 bp, dog
ccacgtagaaagaatatccaacaagacacagagtatatatttcataaaggtctggcatccaaatatatacaaagaattcttaaaactcaacaatatgagaaccgaacataaaaatgggcaaaagaccttaatagcagacacctcaggttacagattaaaaataagcatatgagttgggacatctgagtggctcagtggttgagggtcttcctttggctcggggggtgatcctgaggtcctgggatcaagtactgcatcaagctcctaacagggagcctgcttctccctctgtctctgcctctttctgtgtctcacatgaataaataaaatcttaaaaaaaaaaa

SEQ ID NO: 917 - DNA, 258 bp, dog
ccacgtagttactaatacccatggaatttgaataaaataaattgataaattcttggtaattggaaatactttatctgtgcaccatcgtagtttcccaagcaataccgagcattttgatgatggaatttgcatctaaccaggttttaaaaactaaaaatgtacaaccaacaaaacaatttaacaaaggtcgttttagggagttgtgagcaaatggcagtgtagcttatttcatactaatatcttctctaaaaaaaaaaa

SEQ ID NO: 918 - DNA, 364 bp, dog
ccacgtatgcacatgcagatacctctgggatatctggtagaaaggactagttttggcgtagagcacaaagtagggtctgggagagatggcagtctttaaaagtggttgaaccaggtcaagccttccttccttttggtaaattgagtttcaggctgacatccactcctcctcaatctgtggggcagttttgacagcgttagccgtggtgaattggcggagaactgttaaatcaggatcaccagtaccattttattttctcataagcaagtactgtagaagtagtaagatgaataatttgtacaacttcttgaatgcatttgcaaattacttgtctttgctcacttcgagtatgtaaaaaaaaaaa

SEQ ID NO: 919 - DNA, 247 bp, dog
cgggtaagtccattgtccaaatatagaaataaaataagcattcatgcttgggttgcttaatgtatgggctcctgccattatccattcatggtatacctttcataggccaagcctagtgcttgagacacaaagaagcctaatatatccctgatcccaaagggctcatgatcaagtgttgcaggaggacatataagcaaattatagtgcaggggaatgagtgttctggaggataatgtaaaaaaaaaaa

SEQ ID NO: 920 - DNA, 149 bp, dog
cgggtaagaagaaaccttgacccttggcaagtcagaggccagtgcagcggtgtgcacatgaagatgggtcttggaattggagccctatccttgttgagctaactcttagaaatttctagagtgatatattttgtttctaaaaaaaaaaa

SEQ ID NO: 921 - DNA, 189 bp, dog
gagtgctggggggtattgtaggagggagagtaataggttttttccattgttttccccctgaaactggaaatcgtccttgtcagtgacttcttttatgaataagatgcacacagtagggaaattaagatatgacttctttacaggaggtgacagagcccttcattttcaatttggatttaaaaaaaaaaa

SEQ ID NO: 922 - DNA, 431 bp, dog
cgggtaataacaacgcaatgattggcaaagtgacactgattatgggaacaccagagggtgccctcacttggaccagtatttgagcaattactgatgccaagtcagtggatttggtcttgccccatggagtcatcctaaacatccacatttctaaaggaaatattcactcacagaaataacacttctttttatacagagcattgatgagcctattgtcagaaatttaataactcatttaatatcgtgcactagaaaagaagcatttagggaaggcaagttatctccttgtcctttcagcttccatcaaactcatggagtcatgtttggaaggattaaggctaaaatagaacactgttcttgccgaagtttgttaagagaaaatgatgcattatctgatgagtgttaattttgcttctctggaaaaaaaaaaa

SEQ ID NO: 923 - DNA, 399 bp, dog
cgggtaacgtattacagcaatagaaaacaggacaaaaaccatataatgatggtttaaaacattgagtcaaaatgagcaggtctaaaacaagacctaaactatatatacagctcttaggaaaaaaatacaaaagtaaaggggcgtcaactcacatgaaacggatgttttatacataacacaaagtgcaaagcaaacaaaagaaaaaacacgtaaatcgaacttcctcatgattaccgtataataaattaagattgtattttaaaattgcctcaccattaaaatacaatagattaaaataaaatgaaaggtggggaggaaacgcagaatgcaagtacatatttgcaaatagatcctatatctgataaatatgtatctaacatgttaatttgaaaaaaaaaa

SEQ ID NO: 924 - DNA, 406 bp, dog
gagtgctgacattacaaagtgcattaaataaaaatttccatagtgtaacttaatgatgcattccatatgtagaaccaaatttgatgttacagtgaacactacctaaaaagaaactgcatgcttttctttttcatgaaacatgtgacttaagattggaaatctgtctgatctataaatatattttgtgcaaataataagatgaataaataagataaaaaaaagagagagaggcaaactgtaagaggctcttaactacaggaaacaaggttggtggaggggaggtggatagggaggatggagtatttgggtgatgggcacaaaggagggcacttgatataatgagcactgggtgttatatgcaattgatgaatcactaaattctacctcagagctggaaaaaaaaaaa

SEQ ID NO: 925 - DNA, 265 bp, dog
cggcatatcacagttttaaacgggcttggttaagatgatttgcagattattttaactggttttaattcagctaatcttcactaaatgtgcaaatggtttaaaagatagacctgcagtgaaactacccagtggaaaataacactaaaatgcatttctaagcaatcaagaaaatgacagagctgagatttttcttcttctggtatgagctctttatctgtcactgtacaaagtagaaacaaggatgccctaagctaaaaaaaaaaaa

SEQ ID NO: 926 - DNA, 334 bp, dog
cggcatattaaaaagagcatttttgtctgttatccattggagaagactgtaggattttctgggggcgctctccttggtttagcattctagtcctagcagtcttatttctaattagtacagctctgccttggtactggtggtggttctcatttcttaaaaatgatttactcatttctgcttcatatgacattacatatcattcatataatttcaaataaattttactaattcctgaccttcgcttacttcaaaaactagttcagtaccaatctcttaaaatcatctctaataatctcatccaggcatatgtccttctactctttaaaaaaaaaaa

SEQ ID NO: 927 - DNA, 317 bp, dog
cggcatatataaaatgagagtactattttatttcccagatcctaagatgtccttgaaaaatatacacattttctaaactcagagtgagcctgacaactaatgttaaaagaaactgaacagtagggatgcctgggtggctcagtggttgagcatctgcctttggctcagggtgtgatcctggagtcccgggactgagtcccacatcgggctccctgcacggagcccacttctcactctgcctatatctctgcctctctctctctctctctctctctctgtctcccatgaataactaaataaaatcttaaaaaaaaaaa

SEQ ID NO: 928 - DNA, 228 bp, dog
tcgtttgtagttcagagttccctgggagctcaggtgaaggggagtaaatctctactgatgataaggcccttgagccacagaattctgtgtagccacatccagacccctagatttcacctccacttccagcctgtcactgaaggctgtggtgaccacagctaccactgctactacttcctcctgtttcttctgcttctttaatttcactgcggctacttaaaaaaaaaa

SEQ ID NO: 929 - DNA, 396 bp, dog
acgcaacgtgaagtgttgctggaaactgggttgtggtcgcttagtctaaatgtgatgaggaacagaacaaaacgaaattaacaggattgattttaaaatttgttccctttcttaccttccgaaaggactcgaaggtcttgaagggaaaaaagtctgagtgtagcataaccattaaaatacagaacaaagccgaaacatcatgagaagttttgtatagcagcagctggttttttgtttgccctttttttttttttttttttaaatcaaggtatataactattgttagtattgttattgtttgggggcatgaattttaggtgaaagattcctggcagtctaagcaaaaaaaggaaaaatggttgcctagcaacttgcattgactgataaaaaaaaaaa

SEQ ID NO: 930 - DNA, 329 bp, dog
acgcaacgtaaaatccttggaaaaggtgtgtgctgacttgatcagaggtgcaaaggaaaagaatctcaaagtgaaaggaccagtgcggatgcctaccaagactctgagaatcactacgagaaagactccttgtggtgaaggttctaagacttgggatcgttttcagatgaggatccacaagcgactcattgatctgcacagtccttctgagattgttaagcagattacctccatcagtattgagcctggagtcgaggttgaagtcaccatcgcagatgcttaaatcaaccttttttaataaattgattatctgttgttaaaaaaaaaaa

SEQ ID NO: 931 - DNA, 400 bp, dog
accaggtgcctattgtctctcttttcttgaggaaagtttaattgcttattaaaactaggcttttgaccttgatgggctcaaaaatcttggagcctggcttcctggtcgtaccagtgagactcatgaggtgcaaacaagtttcctttctccagaatctgtaatcagactcccgcctattatttaaacagttagctttgggaatagaagtgtacacagagtcactttaactcatttctggctccctcctggtgcccaccaggcatagtgctagctactgagttggaactcagtaaatatgtgtggatggatttggttccctgctgtggtgaagtgaatgtgttcacagtcatggcctgtgtgttaatttctatcaaccatgtccactacttaaaaaaaaaaa

SEQ ID NO: 932 - DNA, 313 bp, dog
accaggtcccatggaggcagttctgggtggcccacagtgatggcacccacatagtaggtttgcattgcaactaagaacccctgagcttgggggaatgtactgcttttatagtgcatgcatgctcttttctcagcaggaaacattacctcatccttcaggattgctcattacaagcacaactctgagaaatgacccagttaatgagtggttaggactgtgcattctttgttaacttagtaaaatgtgtagaagcacaacaggcccagggaagactgtgcttccccaaaggtattatgagatctaaaaaaaaaaa

SEQ ID NO: 933 - DNA, 426 bp, dog
accaggtggatcatcacataaagcatgtatctcattgttttgtgaccctatatctgccttttattttgtaatgtccaatttctattctgaaatggaatctgtagataacatgagcagattagtcacatatttttaaaattcaatatagtggcttattggtaagaaataaatggaaaatgatttgtaatgaaatgtttgtacccaactactatatatgacataactgtcaaccccatagaatcattgtgactttggcagctgcaaatagagactggtggtattttgatgctacaaatactgctcgagttttgccactggcaaagtgactttccaaaatggtgaatgagtctcaggcttcaaacaacgaaagtactgtcttttcctgatttacacatagttgccttcagtgtataataaaaaaaaaaa

SEQ ID NO: 934 - DNA, 342 bp, dog
accaggtatagtttctgtcaaggggcaaagtcatgttgatttggttataattacagcattatttataatagccaagatatggaaacaacctaagtgtccattgatggatgaatggataaagaaatgggattttattatgcaacaatgtggatgaatcctaagggcattacgctaaatgaaataaggcaaacaggaaaagacaaataccatatgacctcacttgtatgtgcaatcaaaaaaacaatgagctcataggtacagaaaacagattagattgccagtagccagagatggagagtggtgtgggtgggcaaaatgtgtaaaagaggataaaaaaaaaaa

SEQ ID NO: 935 - DNA, 366 bp, dog
accaggtcactacgcaatcgggtgaggaaggaggctatgaaagcggaattgtttgcattggtaaataatgtctgaaatgaacgaggtcttcttaaattgttggtgccaggataatctagtaaacgcgaagaggtgcctcactgacatactttttggacatctgattctgaagcctattggataagcaacataaagagctgctggtgtcgggtgaaatgtttttcaaatacattgggtttgggcaaaaccccaagtgtgtttgtgaagcacttttccctccaatttttgtgccaggcatagagtacagttaatttaatcccgacccatgtgtaaatcgtcaaagcattatttcattaaaaaaaaaaa

SEQ ID NO: 936 - DNA, 250 bp, dog
accaggtcatttgttctactagcatttgatatctgagtcattcctaaatatttggccagcaattaaatgtgtatccgtacaatttctatacagcaagaacatgactttcatatatttaaaatagacctttgggacaggggcgcctggctggttcagtcagtagagcatgcaactcttgatgtcagagttgtgagtttgagcctcatgttggttatagggtttgcttaaaagtagtctttaaaaaaaaaaa

SEQ ID NO: 937 - DNA, 537 bp, dog
agaggcacacgaaaagatgctcaacatcactcatcatcagggaaatagaaatcaagactgtgataagataccacctcacacctgtcagaatggctaaaattaacaacataagaaacaacaggtgttggtgaggatgtagagaaaagggaaccctctcgcactgttggtgggaatgcaaactggcacagccactgtgggaaacagtatggagggtcctcaaaaagttaaaaatagaactaccctatgactcagcaattgcactcttagctatttacccaaagaatacaaaaatactgatttgaaggcatacgtgcacaccaacatttgtagcattatcaacaatagccaaaggaatccctgggtggctcagtggtttagtgcctgtcttcagcccagggcctgatcctggagacttgggattgagtcccgcatcaggctccctgcatagagcctgcttcttcctctgcctatgtctctgcctctctctctcctctgtgtctttcatgaataaataaataaaatctttaaaaaaaaaaa

SEQ ID NO: 938 - DNA, 319 bp, dog
agaggcaggctactgtaagagaagtcagaatgtaccacatttattaagtttgccatcttatatgggcactgcctgtggtgctccaaagtaattacaatatcagtgaccatagagcactatagcaaatatatgaccacagcgaaaaagtttgaaatattgaactaattaccaaaatgtgatagagatatgaagtgagccaatgcggtaggaaagatggtgcttgacaatgttgcaggaaaccttcaatttgtaaaaacgaaagacaaaaacacccagtatctcaaagtgcaataaaacaaggtagtcttaaaaaaaaaaa

SEQ ID NO: 939 - DNA, 223 bp, dog
agaggcaaaaggtaaaggagtgaaaataagtctggtcttttgttacagatggagttgtgtcacccaacactccccccctcttcgccacccagcattgctgatacccaaactgccagtatgattgtatttagagataggacttttaaggtgatatgatggtcaaatgaggtcatgagggtgggaccctattcaaatagaactggtatcttcctaaaaaaaaaaa

SEQ ID NO: 940 - DNA, 293 bp, dog
agaggcagagcaaattttgattcctttttttaaatcacctgattcaggctttttaaagtatacattctttatttaaaccatttgtagttctctctaatatttagattccaagatgtttgaaaatttccttttggataaatccagctgtagaaattagcacaaaataaaatatgaggtatataatggatacagggaagaaaattactgtgacattaaaaaaaaaatctagtgcatgggaatatgattctggtcagtaaaaatatattgtgacattctttgactaaaaaaaaaaa

SEQ ID NO: 941 - DNA, 209 bp, dog
agaggcaatattaattaattaattcatacatttatttattcattcatttattcagcaaatatttacagtccagccacctagaaacgctttccctggggacaaagtcagttcttagagaaagcttcatgtgctacttgatatgtttttcccctacagcaactatctaaaaataatgatgtttttttaatgttcccttttaaaaaaaaaaa

SEQ ID NO: 942 - DNA, 326 bp, dog
gttgtgccgattcattaatttatttggataggtggaagtagccttgcctcccagagataaatctcagttgatcgtggtgtgtgctctttttaatatggtgttagattagatttgctagtattaagtggaggatttttgtatccatattcatcaggaatattggcttatagcgttctttccttgtgatgtctttgtctgtgctggcctcataaaatgaatggggaagtgtttcctccttttgatgttttgggagagtttgagaaagattggcattaattctttaagtgtttaagttgaaaaacccttagctagactaaaaaaaaaaa

SEQ ID NO: 943 - DNA, 399 bp, dog
cagggcaaccatatcgatgttctcgtccgtccagcgcctttcctcatcctccaccagtcttaatggaagaagagtgacatgtgtgtgtatcaggccagagaccatggtgagaaaacaccaggttttgttgggctgggctgactccaaggggtagaactagcttttaccaggaattttcattttctacaaatggaaaaacttaagaatctgaattctggatagcttaaacaatccaagattttgatattaaatataaaactcctcaaagatatggcaccgctacatgtaaaaaaaattcctctgggggcgcctggcatctcagttggtagagtgaggggactccttgaggttatgagtgcaagctccatgttgggtatacagattacttaaaaaaaaaaa

SEQ ID NO: 944 - DNA, 162 bp, dog
accaggtataacagtgaatatttacttttaagagcaaaaaaggtatcctaaaactactcaatggaaattgtagtttttttgatttctcattattcctattcagttaaataaaaagaaatataatttgtggaacataattgacttgcatttgaaaaaaaaaaa

SEQ ID NO: 945 - DNA, 145 bp, dog
accaggtagaacagaattttcctgctagctcatggcagcaccctcctcctcaggcagagtaagatcttgatctcaactctctgtagacatgcattcagtttttagcaaactcctttttcacagaagttgtttggaaaaaaaaaaa

SEQ ID NO: 946 - DNA, 513 bp, dog
agaggcatatcagattataatataagtatcaaataaatttcaagaatcatggatgggtgaaatgcataatgtatgggaaagtggctaatgtcttaaattcatggatgattagatgttgagttaatgagtagttgtgtgcacattgacttgttatggaatcaagcataaaatatctagttatacttaccacttaaaagttaaaagcaaaaattataatatctgatatggttctcagtgcatgtggaagtactatttaagacaactatagcataagggaagtggaagaataatgggacttaaacaatgtttaagtacctacattccacttgaaaaggtaacactagtagactgtgataaaaattcatatgtatattgtaatccctggtgtaactattgaaaatactatacaaagaattacactaaaatatgtagataaaccaaaatagaatactaaagaatgtccaaataacccacttgaagacagataaggagaaacaaggtgaaaaaaaaaaa

SEQ ID NO: 947 - DNA, 186 bp, dog
agaggcactagattgaggagatgaggaggaatcacaaaggagattgagaaaaagcagtcagtgagatagaaggagaaccaaaagagaggaatatccagaaaccagaagaagaaagtgtttcaaaagtaggtagtcaaatataggtaataagttgattaagaagttatcaaaatggaaaaaaaaaaa

SEQ ID NO: 948 - DNA, 171 bp, dog
agaggcactggaggagagagaatcctcacacagggcttgatctcaaaaccctgagatgatgacctgagccaaaattaagagttggatgcttaaccaacttagccacccagatgccccaatgtacatcttaatgtataagagaaaaaatcatgctggctagaaaaaaaaaaa

SEQ ID NO: 949 - DNA, 334 bp, dog
gttgtgcacattcataacttttctgttctctaattttaccttcgttttattaacttttttaaatgataattagaatatttttggctgaaaatatatgattcaaaattttttagattctaaggaaaatgtactgtatcccttaagaattttagataattagtgacattcaagctgattgattcactcgctcaaagattccatcaagaaatcaagttctttgcatcctcccattattagtaatccctttattgcctacataactgaaaaatgacaaggacaattgtcattgtaagcagacaatgacagaatcagtgacattctggaaaaaaaaaaa

SEQ ID NO: 950 - DNA, 541 bp, dog
gttgtgccacctggggaaatcctggctgttccatgtcctctcaggattctgagaacacttctgtttttcccttggaaatgataggtgatttgtggacagaaggggtccacccctcacagtatctctgtcgggttccctggccgagtggtcgagcccaccatggaatccccaccactatgggagggggagtccatttctgagaaactcccatccttttcatgggatccttaactctgcttcaccccatggcatttttatggattattataagcctccgatccacaaaatctttagaagaaaagattactgagaaccatctgtgtatcaggaactttcctacatgctggggatgcaatagtaaacaagagaaaaaaaatcatgccctcctagtacttaaatgtagtgggcaagatctgctattacttgcccaaggaattggaccctggacctttagattaaatgtattaacattcatttcaacatagcattctgcatataattgaacacgcactttagttatctcctgaaggaaaaaaaaaaa

SEQ ID NO: 951 - DNA, 344 bp, dog
gttgtgcagaggccactatcttcaccattgatattcctcttctccagatctcacaggtccctccacaggacacacagaacatagtctgtcagttactgatatagcctgatatactggtttattgagcaggtcaaggcaaatctaactagaggtgtgtcctgctgcagatccaacctgctcttcttattagctagagaagtggccacgttcactacagtgtaggttaagagttcttggagagcgctctccctcagcaaataagaaccttggaaatgtctaagagctatgtcaatagaatctgtaattcaaggtgagtagtcccatttacatttgaaaaaaaaaaa

SEQ ID NO: 952 - DNA, 284 bp, dog
gttgtgcagcagaaacagattctcagttcatttttactcccactgtattatagtttaacaaaaattgtttatatcttggaaaaaaaactttctgtttaaaaaataaacaagtgaatgttggaaattagtctgttaatgttcttaataaagtgttcttggagtttaacctagcagcggatggctttctttagcttagcccagtttccagggaagcattgttttttccaggctgtaaaatggcagagtctcctggatatataatttattctgttgaaaaaaaaaaa

SEQ ID NO: 953 - DNA, 216 bp, dog
gttgtgcatgaaggaagcctacccctggacctcctagttttgcgcattaataaatctacccccctcgctttttattgcttaaaccagaccaagttggatttctgtcaactaccatgtgaaaagtcctgactagaaatagtcactaaagtcaaattgatttaataagtactaagaaaaaaccctctatgactgttctctagcatggaaaaaaaaaaa

SEQ ID NO: 954 - DNA, 408 bp, dog
ttgatcctacatccataaacacgacactatactatctcattaatattatgagagcatctctaacaacttgctaagtagtactatcattgttcttacagttagcaaacttttttagaaggctctggcatacagtcaaaccatatatccacagtagcctcataaataataatatgctatgaattaaaatatgcttaagatatatccttttattatttctgaagataagcagttgctgaccacagccaggctagtaggagtcgaaagtaaaatgctctgtttaattgctttcataattctttatcaccacacaaccataattaatttcatgcttgtgaatttaatcttatatgttaattatatctgcttgattctaagaatgcaaagaagttaattagtgaaaaaaaaaaa

SEQ ID NO: 955 - DNA, 661 bp, dog
tgaattctcacagtagacatttattcctttctagtcaagtaacctggaacacacaaattaaactacctctttaaaatgccatttttttcaagatttatttatttattttagagagagagcatgagagaatacaagtagaggaggggcagaagaagagggaaaaagagagaaagagaagcagactccccagtgaaagtggaactcaatgcaggcttcatctcatgacactgaaatcatgacctgaactgaaatcaagagttggatgcttaaccaacgagccactcaagcacccccaatgccaaattttttgatttattaatagatatacttaatttatcatatgtttcagcaaatcaattaatttattaggataaccaaattaattttaaattatatagtctcagtctctaatagtagaattataataggatccctacgagattgatttgaaaattctagctaaattattcagctataaatttggaggaaattcataaatctttgtttttaatgaaattatatatcatctgctcaatttcaattaagttagaaaagttaaataacaatatatgtgtgtttaatcagtacctgaaaattggttttatttctcatactgttgaaattctaactagtgcctatcattctgttgggaaaaaaaaaa

SEQ ID NO: 956 - DNA, 423 bp, dog
tgaattccagacctagaagaagctgagagaactcaatgagtgctatctgcacaaataaatagatgaacaaatgaaatgatataaacatatttatccagaatttgaaaaagtggtcaatgccatcaaaagtggctagctttatgatagctaactagctggatgtactactcctatacccctttctcatgagcagtaaagatgaagtgatacaaacagatttgtgatcttttattcataggacatagtatgtgtgtgcatttatacatacagagatatgggaaggatgctgaccagaaagttcatggtagctacctcagggtaatggaatttgatatggctggatgtgatttttaattctttcttctagaactctaatttgttaaaataaacatgagtgatctttatggttaggaaaaaaaaaaa

SEQ ID NO: 957 - DNA, 375 bp, dog
tgaattcacgtttgttaattaagttgaacttttttcaaggaaaataacaacaattctctactgcatttctgagaacagaaagaattaaaatacttcaaaggtaggacagttacaccttaaccttttttaatgtcaaggataaatgcaaatttaaatgcattgcatccaattttaattttcccccaaatgatactctaaatagctcagaaatactatattgtgcaaagtagttaaaatgataattataattttattatcttataaaatgaaaagcaggagataccatacacatatctgtaagtactaagagggagaaatggacagaatgttacctacacatgtttaaattaagaataaacttatgaaaaaaaaaaa

SEQ ID NO: 958 - DNA, 333 bp, dog
tgaattccagattcaacaaatactgtctactgtatgtccctaggcacattatttaatttatgctttttttcataatttaaaataaagggtatctcctagggatacaatgattaaatggatcaatatgtatctaaaccacttaaataagtattcctaataagtgttgcagatgaatgttagtcattatttttatcatcctgtaagccattttaaacattagcaatgaataagtgaaaaattttttaaaagacagcatatgtagtaattttaaaattattaaaaacttagcataaattctttaaaacctgttatatcctcatggaaaaaaaaaaa

SEQ ID NO: 959 - DNA, 432 bp, dog
tgaattctagtctgtctagtgtttttgcaaaaatgtttatttttatattatctgtgattttaatatggttgaactagatttctttgtgattaacagtttcactgaatgagcggtatggaaacagtgttacttgacattttgagccttctcaggtttatctaaatcaacggtagcttaacaaattccagacttactgtacgtaattgtgtttttgataagaggaatgtatgtatattttttctaagtttgcatgcaggaagtgtacaataccgtgtgtttgtgtatgtgtgtgtctaaggcatgcggccaccttactatctgctatttataataggagagctttggtgtgatcatgatcatcaaaattgtacctattatagacaattaaaactgaaaaagtctcaataaaactgtaacatgtgaaaaaaaaaa

SEQ ID NO: 960 - DNA, 215 bp, dog
tgaattctacactagagtttggattttattcaataataaaccacccaggatttttaaggaagtgacggaaattccttgaccaattagtgtttattgttttgttttgtttttaaaagaagataactctggaagcacaaagatggatgaaaaaagttagaggttgaaagtaagtagattatttaggattttaagcaataacagtggaaaaaaaaaaa

SEQ ID NO: 961 - DNA, 180 bp, dog
tgaattcagaaaaacttgcatgagataggagttaaatcagtatctttaggatttatgatgccagttatagaaataatgccaaaggcatttccctggtactttactaaaactctccctatttacaaaaggagattttaaagccaaataatttcaactatttttttaatggaaaaaaaaaaa

SEQ ID NO: 962 - DNA, 524 bp, dog
aaatcgagagttggacacttaactgactgagccactcaggcgcctaagacaagattatttggaatagaagcagcatcaaaatatataaaacaaaaactgacaaaagtacaggaagaaagtgacaaataatcagtggcagattctcagtaactgacagtacaactagccaaaatcattagaaatacagaaaagttgaataacataaatagccacatggatattaaatgagcacactcactgatacagaatatacaatgtcttgtagtgcacaggaaacctttataaaaactgatcagctaaaaaagggcatgaaacaaatcttaaccaattccaaagattgtctcagagggagtatattctctgactgcaatgaaaataaaatgaaaatctaccccagtagatgtaaaaagaaggcagctcacttggagaagagcatgtgactcaagtgatcttggggttgtaagtttgagctccatgttgggtgtaaagattacttaaaaataaaatcttcagaaaaaaaaaaa

SEQ ID NO: 963 - DNA, 420 bp, dog
aaatcgatgaaggaatataacattaacatatgactcaaggatgtaacattgttaagatattctctctcatattcatctctggagtcagtgcaatcccagtaaacaccttagcagcttttttaaattggtgaacattgacaagctacttgtaatctgtatttggaaatacaaaggatctagaagaactgaggcaatcttgaaggagaaaaacaaaaccagatatcaaagttagagttagagtgattaaaagtgtggtattaatataagaatagacagtagacagtggaatagaatagagtttaatagatccacacccatatgattagtcatttcattcatgacaccaccacagcaattcagtggaagaaagatggatggtcttttcaataaacagtgctggctcaagtggaaaaaaaaaaa

SEQ ID NO: 964 - DNA, 392 bp, dog
aaatcgaaatagaaggtatatttttgtgtgtttttttttttaagattttatttattcattcatgagaggcacacagagagagaggcagagacacaggcaggcagagggagaagcagagggagaagcaggctccatgcagggagcctgacgcgggactccatcccgggaccccgggatcaggccctgggctgaaggcggcactaaactgctgagccacccggcctgccctagaaggtgtatttttgaagaaaatattcattcttggtttataaagctttggggtctttaacttaagtaaactgcatctgtgtttccacaataatattaaaaggtattcattgtaaattaaataggtacctgaaatcaagtacctagattttgaaaaaaaaaaa

SEQ ID NO: 965 - DNA, 519 bp, dog
ctatttccatgagggaagagatctggagagaaaggagaaagttgtatactaaatccttttctgcttttacagttcttaagggcaaataatcttgaatttggcattatcctgttgaatgattttaaatgcttgggttctttgtcacatgatggtttgattcttttctctatttggaacaataatcattcactaagaaaattttcaggtttgagtaggttaagaacgactaatttatgtgaatttacatagagctgtaacactggtccaaaccaacaaaactctataaaactatatagagtgacacgaagcaacattattaatttctaatattggcacaattagactgaaactgcttctatgtttactgtgagctgattgaatttggtaatttggtcaagtcttgactttggaaaggaacaacatgagtgcatttatcaagtccttaatttgagaatttatctttatgacttgtaaggttgacaatacctcccttaaaaaccactaatagaaaaaaaaaaa

SEQ ID NO: 966 - DNA, 499 bp, dog
ctatttcgagtaaggactgttgttatgacaaccttgcagatgagaacctgcagtatagtcacagtcagaaaggcacatagctattaaaatagatgagtcaggattcaaattcaaactggctccatttcctatactcttaacttgtcttctgttctgatctcttacattcttgtgtcacatacaaagctttccaatgcccactctggtttatggaaagttgcttctttgaggattgagactaagttagcaaaaattttctcatttttaccagaggcatgaaattggagagtggttataacctcatttctaatcttatatcagaccagatcatcagtaagctagttagttctatattttagtacaggtggtacctctctccctccactgccatttgaacatttgcattatgccattccacttttgtgaaagacctccataagtacctgttttcactaacagatatctcaagaggatttttgcttttatggaaaaaaaaaaa

SEQ ID NO: 967 - DNA, 388 bp, dog
ctatttccattcctatttacttttcttaaaataaccaagccattttcagaaagaggagctgatactcaaagtaatatttctgccaagaatccaagaagaatcctattgattactttctatctattgatgattgactcatattatgggtaactccaggagtcatggtggtctgtgcttatagctggttgactcttgcatttccttgtgagttctctgggatacgactgctgcttctggttcatggtgaataataacatatcttggtgatagtagtagcagataagagtgctaaagctaggcagaagtttctgtgtgggtgtgatgggattgaacactcagggaggaatagaaaatgtttatcatgtagattatgcacaggttctgcatg

SEQ ID NO: 968 - DNA, 280 bp, dog
ctatttccaccatcgtacttgctttttagttaagtaggaaaataaaactattaaaaagaaagaattaggagtgcctgggtagctcagttggttaagcatctaactcttgatttcaactcaggtcataatctcaggatagtggaatggagcccctattggggctctatgctcagcaagagtctgcttctccctctccctctgcccctccccctacttgggcttgcgcgtacacccacctgcactagctctcaaataaataaaatctttggaaaaaaaaaaa

SEQ ID NO: 969 - DNA, 255 bp, dog
ctatttcagggattatcaaaaatacatcataactacaagtcaacacaaaaaaatctgtatgatgaaacataactaagcggccagcagagtatctcaaaggaatgtattcttattttattatgggaaaaatcttgatatatgaaattaaagattatcatgaagaataaataccatattgattaatatatttaacatgagcgtggagtttactgattatttatcttcaagagctggagtgacctggaaaaaaaaaaa

SEQ ID NO: 970 - DNA, 187 bp, dog
ctatttcataccctctcccactacaaactttccgtgcagttacctttcatttttaaagcaatttcactgctaaatataaattgtatttgtggggttcatagttatataatgctgaagggaaccactctttcgttgaaaggtgataaaagttaaataaagactgtctccacagtaagaaaaaaaaaaa

SEQ ID NO: 971 - DNA, 152 bp, dog
tgaattcaagaaaaactgtagcctagagatgtaaaatcagtgactgattcttgattggatatggcaaaataggctctggacttgaaagcactggtatagtgagaagagagttcccaaggggaatagcatagagtgatttggaaaaaaaaaaa

SEQ ID NO: 972 - DNA, 327 bp, dog
gttatagaattttcacaaaggcagaacaaatttgcaatagaattagtaagagaaatccagatttgattatgttctaggtgtcaccaactcaatcagggaatttcacggggaattagaaaaattccacatatcattcaagaaaaagagaaatcaatcatgcctatatgggttcttgtttactgtgctatctttatggtaggaggttgcctccggaatcaagtatgttattctatgaaggaaactttcctccatgacctggtactatattaccatatagagataaaagtgaaagagaacttaagagcaacctggattgaaaaaaaaaaa

SEQ ID NO: 973 - DNA, 147 bp, dog
gttatagtgcttggcacagaaatgatgttcagtctgtgttgatgaatggttaaaaatacctgtcaaatggtcaacaaaagaacactttctactttatgtcattcatgttatgaaaatataaatgagttaccttgtgaaaaaaaaaaa

SEQ ID NO: 974 - DNA, 215 bp, dog
cagcagcctaaacgattgttttaaaactgaatcgaagaaaaaaaaaactgaatcgaaggctatagtaagcgagagtcacacatgctattagttttcgtccctttttctatcttcgccccgacttttaaatttgaacctcctttgcaaacacctaacacttaaatttgaaattattttttactgttatagaaggagatttttaggaaaaaaaaaaa

SEQ ID NO: 975 - DNA, 745 bp, dog
caagaccttcaactttacaaccagacccaagttgtatgatacaaaatcaacatacaaaaaaatcagtgacatttctatatacaaacaatgaactatctgaaaaggaaattaagaagctaatcccgggcagccccggtggcacagcggtttagtactgcctgcagcccagggcgtgatcctggagaccctggatcgagtcccatgtcaggctctctgtatgatgcctgcctctccctctgcctgtgtctctgcctctctctctctgtatctatgaataaataaacaaaatcttaaaaaaaaggcaatcccatttataatagcaacaaaagaatgagacacttaggaatatacttagtcaagtaaaagatttgcacactgaaaattataaaacataaatgaaggaatttaaaggagacagagaaatggaaagacattccatcttcatggattggaagaattaatgttaaaatgtttgtacaagccaaagtgatttacagattgagtgtgaccctgtcaaaatcctagtagcattctttacagaaatagaaaaagtaatcatgcaattcatatgaaaccaccaatgaccccaaatagccaaaacagtcttgagcaagaagaacaaagctggaggcatcacacttcctgatttcaagtgatttttcacagagctagaacgggcaatcctaaaatttgtatggaaccacacaagaccctgagtagctaacacaatcttgaaaaaaaaaaa

SEQ ID NO: 976 - DNA, 187 bp, dog
caagaccaacaatcattttaactagtagaaaagctactccttgactggtaaacctcagtgggcattcagtctaagtgggaagagttctcaacataaagaaaagcataaatttaaacattttgagttactttgcaaggcagtaataacataataatcactgtaaaattaagtcctggaaaaaaaaaaa

SEQ ID NO: 977 - DNA, 294 bp, dog
cgtacgtgttggattgtggatgccctgagcagacattaggcttccaatgggaaggctttgctccagcccagggtggactgcttgcactagctggcagagtccgtgtatgctctggccagttgggtgtgggaagaaagggacagaaggaatccagacttcaaggagtatgactggaatagatcagtggatgaaagcagcatcattgatgtgggacagactgggggagaaacattactgggaggaatgcaagatctcactatagagcatgttaagcttcgtacgtaaaaaaaaaaa

SEQ ID NO: 978 - DNA, 294 bp, dog
cgtacgtgttggattgtggatgccctgagcagacattaggcttccaatgggaaggctttgctccagcccagggtggactgcttgcactagctggcagagtccgtgtatgctctggccagttgggtgtgggaagaaagggacagaaggaatccagacttcaaggagtatgactggaatagatcagtggatgaaagcagcatcattgatgtgggacagactgggggagaaacattactgggaggaatgcaagatctcactatagagcatgttaagtttaagagctaaaaaaaaaaa

SEQ ID NO: 979 - DNA, 268 bp, dog
cgtacgtcatgcaacaccagcagaagcacattaagtcttccagaagaccgtgccttaggaatgctttagaatctgagctttcttttaaagacagacttaataatgtggaatattttctagatatcatttttattaggttgaactgaaaaagtttttgtaaattttttggccccaaattttttaaaacatagttactttggactaggggtacattcttacaaaataaataaacagtttttaaaattgtttaaacacgtaaaaaaaaaaa

SEQ ID NO: 980 - DNA, 388 bp, dog
agcagcagagttcatttctcactcagccctctggattgctaggcctagagacaccccaccatcccagagcagagaatggaagacttgcctaggcccccacatggcctggctacagaagcagctaatgcttggatcaaaacgatatggcctctccctgcatttaaaagtatcgttttctcgttctctaagtcttaaccttcttgtttaaaaagaaaacaaggtacatctgggtggcttagtggttgagcgtctaccttcagcacagggcatgatcctgggtccggggatcaagtcctgcatcaggctccctgtgaggagcctgcttctccctctgtctatgtctctgcgtctctcatgaataaattaataaaatctttaaaaaaaaaaa

SEQ ID NO: 981 - DNA, 223 bp, dog
gacctttgtatctttcattttagattgagtcatggaagggtgcctattttaagtcacgttattaatgcacttaatgcctactattcagacagtgatgtagaggttaaaattgaagtacttagcttattcctttctgtttctttggcttagcttgagggatatatattacatctttcaaggtggacataaatatttagacacaaagttactgggaaaaaaaaaa

SEQ ID NO: 982 - DNA, 292 bp, dog
cggtccttgaggagacaaggctatactcacgaatatgaaggtgagagtgaaaatcatgtggatatgaggatcatttaggagaggtagatgataccaggcaccaagcttccctaaataataaatatgtgagaatatgagacataagagaaacagtgttcctttatttattgtaccctttttctctttaattcacagtcctctaaataaagtagggcaggatctgtgccctacctccctgtggaacactgaaatcaattgtttgctttaagtgacatagcgatgaaaaaaaaaa

SEQ ID NO: 983 - DNA, 221 bp, dog
tgcaccgcgaaaacaaagaggacagagaaagtaagcaactttgaataaatggttggaatgcagtaaggctatatataatttattttcatctcactgaatatatatatgagttgttactgaatcatttctcatgtttttcaacattcatagaatgctttatgcctcaccattacccctaaaaaacactccttttctcaaaatttcttgtgtaaaaaaaaaaa

SEQ ID NO: 984 - DNA, 175 bp, dog
tgcaccgggagacagtatatgttaaaaaattatgtattgatgagcactgagcaatgtacagaattattggatcactatattgtacatttgaaactaatataacactgtgttttaactatactggaattaaaattaaacatacacaaagtatttaaggagtaactaaaaaaaaaaa

SEQ ID NO: 985 - DNA, 235 bp, dog
ggctgactcagtcggttagagcatgcaactcttgatctcagggtcatgagttcaagcccacagtgggtatggagcctatttaaaatagaataaaataaaattaaattgaataacattaaattaaattttacaaaaaagatttgagtcctgggatacatccattatttaatataggttaacttagcttgcctaagagcaacatggtttcttctgcaagatagtttaaaaaaaaaaa

SEQ ID NO: 986 - DNA, 144 bp, dog
ggctgacatcagactagatatgttatggttcatttttcagatagataaaggttactcatttatgggttaaaaaacgatattagcaattaggtatataattcctcagattgtataataagtatattaccagactaaaaaaaaaaa

SEQ ID NO: 987 - DNA, 228 bp, dog
ggctgacccagtgcaaatgtcttccccttccatagcctcatgtttccatgtacaaaatgcaggcagtaattgtctactgcatccggtgggggcttacaagacgatattgttccggctcacattcatgcccaccccctcactcccggaaaagcagagaaagaaaaaagtctccctgaagttacactggtaagcaatatcactaatcttgttgctagctaaaaaaaaaaa

SEQ ID NO: 988 - DNA, 308 bp, dog
cggtcctggacagagttagcaaccctgtgggtactgactcagaaagaaaccagaaatgtataagcagaaacagatcctagagcttctggagatatagaggatttttttgatccatccttttgggaaaaaaagcagaagtgatggttcacatgtcccatgagaagacagcctccaaagacctcaggggaagggtgtgaactgtgggagagggaaaggggtgaggtgtagggtaggatgggcagctttgagccaattccatatttaccaaactttaccaatccggtagatggcttagttaaaaaaaaaaa

SEQ ID NO: 989 - DNA, 164 bp, dog
ttatccgcttgaaaattcttgcccgttaggtgacttgatccctggaatttccactttgataaaatgtgattggctgcaaaccctaagtcttcagggccacctgattttctcttactaatttgtcaatggtttaattttcctttatgcttctttaaaaaaaaaaa

SEQ ID NO: 990 - DNA, 160 bp, dog
gcctttagctaccttttctaacatgtatgctaccatcactttaacaatgtttgagagtgatggaaatgggtttgagagtcataatttatattaaaaatgtgttggacttttaaatacatttttcaaataaaaaaaagtttaaacaaaataaaaaaaaaaa

SEQ ID NO: 991 - DNA, 226 bp, dog
gcctttaactatttacatttaatcttttagaaaaggtttatccctggggttcctgggtggcgcagtggtttggcgcctgtctttggcccagggctcgatcctggagacccgggatcgaatcccacgtcgggctcccggtgcatggagtctgcttctccctctgcctatgtctttgcctccgctcctcctccccctctcatgaataaataaatcttaaaaaaaaaaa

SEQ ID NO: 992 - DNA, 158 bp, dog
tatttatgcacggatgcttttgaacagtagagcgaaatgctagacatggggaatctgctctgtttgtcctttatacatttctgtagttaacagaacactgtaatgtgccttggagcttagtaacttgtaataaattcaattgatattaaaaaaaaaaa

SEQ ID NO: 993 - DNA, 171 bp, dog
tgaattccaatgccggctacagtgctcaccatctcagcttctagatcaatctataaaaatcaacatgttttatgaaatgcatgttactttttttttccttttggtacctgaagatttccaacagaacatacagaaagtttctgcaacacaaatactctttaaaaaaaaaaa

SEQ ID NO: 994 - DNA, 213 bp, dog
tgaattcagagcaagaaaagaatctatgaggaggcaccttgatgtcaccgtcagtttaagcatctgactcttggttttggctcaggtcatgatctcaaggttcatgtcctctgcgctgagcacagtctgctaaagtttctttctccctctccctctatccctcctcacctcgagttctctctctaataaataaataaatcttaaaaaaaaaaa

SEQ ID NO: 995 - DNA, 136 bp, dog
aaatcgagagtcagacacttaactaactgtgccactgacacgcccctgaataataatgttttgaatattaataaatgaagtatttagagagttttacatcatgcagattaaattcaatttccgaataaaaaaaaaa

SEQ ID NO: 996 - DNA, 147 bp, dog; identical to SEQ ID NO: 188

SEQ ID NO: 997 - DNA, 156 bp, dog
aaatcgattgggtgtctgactcttggtcttggctcacgttgtggtcttggggtggtgctcattgggctccttgctcagtggggagtctgctggagattctctttccctctccctctgcccccattcatgtgagcatgctctctctaaaaaaaaaaa

SEQ ID NO: 998 - DNA, 150 bp, dog
aaatcgaaagcagtatgtatccctagttgttagctataatacaaatgcattgagtgtagggtcacgaaccatttggattccttgcctgctaacttcctggtttatccttctctatttccctttggaaaaataaacaggtaaaaaaaaaaa

SEQ ID NO: 999 - DNA, 195 bp, dog; identical to SEQ ID NO: 206

SEQ ID NO: 1000 - DNA, 129 bp, dog
acgttagggctgatactgaaattttttgaacttgaactacctcagccacttaccagacactgaatgatctggcaaatgactttttcagatttggtaatgtttacacgtgaactcagtcaaaaaaaaaaa

SEQ ID NO: 1001 - DNA, 143 bp, dog
atgaaggtggggtaagattatatataattggaggaaaagttatatgaacttaaaagtatgtcaagttcttattagatctctgtactgaaggttcaattttttttaagttcacttttcacctactctttgtgcaaaaaaaaaaa

SEQ ID NO: 1002 - DNA, 198 bp, dog
aataacggagctaaatgacttcctatcttacttaaggagtactagggctctgtatggttcatttttgtttgctgtccattgacttaattgaccttcctgaatcaaaaatttttctatgggctgaaatgccatttaataagcttaagtactccttgaatatttaaaaattaaagtatttatgatgtccaaaaaaaaaaa

SEQ ID NO: 1003 - DNA, 127 bp, dog
aataacggacacgcgtgaacattcatgacctgtcaccaaacccaagaactgcagtattgctaatggtttacgcaatgatccttttctttcccattctgctacctaccctcccccccaaaaaaaaaaa

SEQ ID NO: 1004 - DNA, 713 bp, dog
aataacggaaaaacctaagggagcacttgctaatcatcatggcaatgaatatttcaggcaagaaacactgaagcaggctcgccaaagggttgagcatttggaggatgatgggatataaacacagcctaaagccatctcccatgagatacttctaaatcgtaatagagaaaagtaactgctgtacgagagacacctggaagaccatctgagggagatggcccacgtgaacgttgctgctcctcctgcccctgcacctcctgagaggtcactgagaaaaacgtgcatcacctgcacagcctcaccacgagtcagcaggcacctgcaaaatgttacggtgaaacaggaaggccaaagaacagctctgaggtataggacacaggagagacctgaccaccgcatgcaactcacgatcttggagtttattttgccagaaagtgtatttgaggccaattgggaaattttttttaaaaagccaatactaaacccgtttcactgtaaattttctaatctttataactgcgtgttatgtacagttgtttgttggaagtacacggtgagctctaagtattcacagaggaagagaaaataatacagctggtgtgtcaaaatgttagctatgaggagtatgtctgaaggtcatgggacatagttgtatcgctctggcaactaactctttacatgtctgaaattgtgcccccccccaaaaaaaaaaa

SEQ ID NO: 1005 - DNA, 263 bp, dog; identical to SEQ ID NO: 610

SEQ ID NO: 1006 - DNA, 159 bp, dog; identical to SEQ ID NO: 671

SEQ ID NO: 1007 - DNA, 203 bp, dog
tcaaagacatatgaatacacagaaccaggggactattagtttatttagtaaatcttatagtgtgatttatttctctgagccagttggcaatcctcaactcttttcaaatattaacgcattttatcctcacagtaagcccatattgttggtgctattactgtctccattttacagattaggaaacaagggaccaaaaaaaaaaa

SEQ ID NO: 1008 - DNA, 225 bp, dog
tcaaagacacacacaacctaaccttatacctaaggagctagaaaaggaacaaaataaaggtcaagagccagtagaagaagggaaaataaagattagagcagaaataaacaatacagaatcaaaaaaataaataccccacaatgtattaacaaaactaagagctagttcttggaaagaattaataaaattgataaactcttagccgcacttaaccaaaaaaaaaaa

SEQ ID NO: 1009 - DNA, 298 bp, dog
tcaaagacaaacaatcaagtattccgagcagtctgtcatgaagggaaaatgacatatcctgtttgtgtataggttatggttaagatgcagttttataattaaagtatatacatttactgagaatttttattatcagtccaattctcagtttattttgtcaagtattgtgtaactcatttatattcataaatcagaatttgtattaaatatgatgtggatgacgtaattataatcagaggaatgaataaatcacttcttaaaagcacctcattaaaacttggcaagccaaaaaaaaaaa

SEQ ID NO: 1010 - DNA, 307 bp, dog
tcaaagatccaacagaaatttttttgaccctagatttctatgtctagataaaccttcaagccactgtgagagccagataaatttttgacatgtcaagaatgagaagaaaaaaaaaactattgctgaagtgctgggtgaccatataatttatcatccaagccaggatcttttgagaattaaaagcaatctatcaatatttatgtcaggacatatgaataagccaagacattcctgtgacctccctacaaaagaatactgaggataaacctcaggaaaatgaatatcagcccccccccaaaaaaaaaaa

SEQ ID NO: 1011 - DNA, 173 bp, dog
tgaattccaattagttaacatacagtgtaatattagtttcagatgtacagtgtagtaattcaacacttccatacaacatcctggggtcatttcagcaaatgcactccttaatccccatcacctctttataaaccattacaaactcttatttgattgcttcacaaaaaaaaaaa

SEQ ID NO: 1012 - DNA, 151 bp, dog
aaatcgatgtcctgttatttgaatattttttttacatcagctattcctaatcttttccattataaggacctgtttaaatgtaaaaacctttttcagaacaagcacaatttcaattatacattctgttggcaggctttgacaaaaaaaaaaa

SEQ ID NO: 1013 - DNA, 154 bp, dog; identical to SEQ ID NO: 645

SEQ ID NO: 1014 - DNA, 422 bp, dog
agttatcatagtttaccaacgtgacatccctccccagccagccattaccgtcctataaactgctgtgtttgactccggggcactaggcacacaagggctctgtgacacagaccttctagggtaatccaatccaaagttgcaaataacatctggtgtttggctttgtggcataagatgaatttttctgggtgtagttgagtctgtgtcggctgcccctccccctgccccaaattactaaggtcacgtagtatttcccgattgaatcattgaactcccaggtggcacatctttttgaagttttgtatatcaatcctttttatttcttcagtgcactttttccctttagttgaaaggggaccttggattggctttttaaaggtgggacaaagagacctcacactgtctggaaccaaaaaaaaaaa

SEQ ID NO: 1015 - DNA, 228 bp, dog
agttatccatccttttaagataaaaataaaatgtcctagagctaattctagcttaaatttgtcaatatttttgtacattattaagatttttttcctccaaattttgtaactgaaattctgttagtgtttgcatacttaatggcatctatttcaatattgatttggtaattataggtagaattctgatgctaatttaaagtttaatttgccctttctcaaaaaaaaaaa

SEQ ID NO: 1016 - DNA, 215 bp, dog
agttatccaagagtatttactttcttttgtcccttgccgtccttggcatttcatagacctattactcaggttaaaatactcattatgtgtataagacctttgcagagagcctaaagatgcttctttccaggtgcctcttcagagagctgacacctaattttgtgcctttggcacaaatgtgctgagtagattgatcagttggtacaaaaaaaaaa

SEQ ID NO: 1017 - DNA, 162 bp, dog
agttatcaaaccacacgttgagaaccatgggcctgcactcattatttcctttatggctgcaaagtggtaatattttatcactaccttatttattttttgtagtgctccctctcatatatttggttatcctagggtggtacattttgaatgcaaaaaaaaaaa

SEQ ID NO: 1018 - DNA, 145 bp, dog
agttatccaagtagactaggtaagtctatattctaggacttcattacttcatcctggctttcgaccaaggtaggtgggtttgagtcctgttccggagtccaccttagacattgtaaatcattgtaaactcaccccaaaaaaaaaa

SEQ ID NO: 1019 - DNA, 221 bp, dog
caagtttgcacaattaataaagaaatgtggggccattggtgtaaacaagccatctcattagaaccagaacttcctatttgtctaatttcttggatagataatgccagttaattactttatgaatatggtatttttctccaaatcacctctatgtgtctaaaatggttctttctgtaaatcaatgagaaaataattgaaccgaaaaatggcaaaaaaaaaaa

SEQ ID NO: 1020 - DNA, 113 bp, dog
caagtttggaagagggtgtggtaggaaaactgcttgttccattcaccagcattgctacatatttctcagaacaccaataaagaggtcaatgcatcgcgtcgcaaaaaaaaaaa

SEQ ID NO: 1021 - DNA, 296 bp, dog
ttattcgagaatgtagtgttattaaacaccatcagcggccttcaggtacccagtctattcaggcacaactgactggttcacagcattccttacatagctatctatcaaatgcaagcgtagttaattttcaggaaacaagcaggcagtcatctttatcctgtagcccaattggagattctactcaggtgagcaatggaggattacaacagaagacctcccaggtgtcagtggaacttgctcagtcttactcatctgcaattccatcatcagggtttcctcctactacaaaaaaaaaa

SEQ ID NO: 1022 - DNA, 292 bp, dog
ttattcgggcaaacaaagctcgtgatgactacaagactctcatcaatgccgaggaccctcctatgattgtggtccgaaaatttgtccacctgcttgaccaaagtgaccaagattttcaggaggagcttgatctgatgaagatgagagaagaggtcattaccctcattcgttctaaccagcagctggagaatgacctcaatctcatggatatcaaaattggactgctcgtgaaaaataaaatcacactgcaggatgtggtttcccacagtaaaaaacttaccaaaaaaaaaaa

SEQ ID NO: 1023 - DNA, 278 bp, dog
ttattcgagcaacagaattatccttgtaatttaaatgttttaaaagtaaatgttttaaagtaaccctttagctgtatgcttacaagataacagacttttctatgataccctgcacttgggtctcaattagaccttaaaagataaatgtgaaaaagcacaataaactgccatttggtgcatgaatgtgtgtgtgtgtgtgtgtgtgtaagtagtatgggctaacgctagtgatctggagttctaaaacatatttttacctatacttccaaaaaaaaaaa

SEQ ID NO: 1024 - DNA, 273 bp, dog
ttattcgacctgttaattttggggagttgctggtgacttcaaaattgagtgaattaaaaaaaattgagtgaatttagtgggatacatttcactgttgaccattctaggataattttgcatggtgcaggataagacctttcaatgtgtagattcaggtttaagtttccttgtatggaaattttgacagatctttttcagagtctccaattgcacggatttcttttccctgcatttcttatccataaaattttcctactttacaaaaaaaaaaaa

SEQ ID NO: 1025 - DNA, 220 bp, dog
ttattcgggagtacggccatggcaactagtctcaccaatgtaggaaattcatttagtggtccacccaattctttagttgctagatctaataagtttcaaaactcatcagtggaagatgatgatgatgttgtttttattgaacctgtacaacctcccccaccttctgcaccagtggtagctgatcaaagaaccataacatttacatcatccaaaaaaaaaa

SEQ ID NO: 1026 - DNA, 165 bp, dog
ttattcggcatctgttgtatgccagtcaccctgctgaagtttttaggagatgattgaaataaccctgactgcaaattatttaccttctaattaataatttaaatgttttgattgatttaaggtaaaagaaaggaaaaaaaaaataaaactgttccaaaaaaaaaa

SEQ ID NO: 1027 - DNA, 157 bp, dog
ttattcgacccggtgctgtaagtcctagctgcaacagtcaggctagaagaagaaataaaaggcatctagattggtgaagaagaagtaaaattgtcatcatttgcagatgatataataccatatatagaaaagactaaagactccaccaaaaaaaaaa

SEQ ID NO: 1028 - DNA, 135 bp, dog
ttattcgacacagtagtggaagtcctagctacaacaaacagacaagaaaaataaaaaaattcaattcaattggtagggaagaagtaaaactttcacttattgctgatgacatgatactgtatacaaaaaaaaaaa

SEQ ID NO: 1029 - DNA, 135 bp, dog; identical to SEQ ID NO: 1028

SEQ ID NO: 1030 - DNA, 124 bp, dog
ttattcgaggagggcctgaaattgtggtattacctccaagcagattctctgaaagggacaaagggatggggtctgtatataaactattctgcttcctcatttctctaactggcaaaaaaaaaaa

SEQ ID NO: 1031 - DNA, 256 bp, dog
gttatagtaggtagtcatatggtttatgtctttataaaaaataggaacatctgacattccagtgttggtcaccagaatttctattgaaatataaaactctactattgtcttagaactttttctaagtctaacagctatttacttgcaaggagacaatagtagctctgagcaggtacctgtggtctccagtggaatctggaaagaaaacattgattcatgtatatgaactaatacactgatgagccaaaaaaaaaaa

SEQ ID NO: 1032 - DNA, 177 bp, dog
gttatagatgtgcattattgttttcattgtccaggaaagttatagtaatacattgttgccatagaggactttgaagttgtgatcctgttagcattctcagtctttgtataagaatactaagaataatcatagatgttatacattagccataagaattgatctgctcaaaaaaaaaaa

SEQ ID NO: 1033 - DNA, 171 bp, dog
gttataggaccagagacttaatctctccagtaacatctgatggcactgttctcttcataagcacctcttcctcctttatttaaattaaaaaaaaaaaaaagtatcttcaattatctgttgtcaagagggagatccataatgaatacgatcatacgtgtccaaaaaaaaaaa

SEQ ID NO: 1034 - DNA, 168 bp, dog
gttataggaccagagacttaatctctccagtaacatctgatggcactgttctcttcataagcacctcttcctcctttatttaaattaaaaaaaaaaagtatcttcaattatctgttgtcaagagggagatccataatgaatacgatcatacgtgtccaaaaaaaaaaa

SEQ ID NO: 1035 - DNA, 186 bp, dog
gcaccatacttttttgatcattagagctctgtatataacttgaagtctaaacattttttttgaagtctaaaattgtgatggcccagctttggttttcttttctaacaccgctttggcttttttcaaccttttgtggttctatacaaattttaggattttttgttccagctctgtgaaaaaaaaaaa

SEQ ID NO: 1036 - DNA, 208 bp, dog
ttaccgccccattctacagatgagacactgagacccagagactcagaagtgaggacaccatctaggcttacctgaccctgaccccagcctggcctcccagctctgaggtgaagcccctgtcacccatccctggggtgcagactgggccaggcttactttcccacacctgacaccccctccgggtccaaccttctttgaaaaaaaaaaa

SEQ ID NO: 1037 - DNA, 200 bp, dog
ttaccgctctacttaacttatatttctacctgcgactcacatatagcaccgcacttaccatatttccatccacaaacaacataaaaataaaatgacagttcgaatacacaaaaaaggcaaccctattacctcccttaattattacctcaactatactactcccactaacacctatattatcagtcttggaaaaaaaaaaa

SEQ ID NO: 1038 - DNA, 115 bp, dog
ttaccgcactcacatacacacacacactgtctcccaaataaataaataaataaataaataaataaataaataaataaataaataagtaaataaataaatcttagaaaaaaaaaaa

SEQ ID NO: 1039 - DNA, 270 bp, dog
cgggtaaagaatctcggtttcagacaccccaagagatgccatagaaatagattctgaggagctcctactgatcacctcatcttacatctttatatattctccacccttaagtgaccatcgtcacaaataaagcattaggctctgcccccacgtagagcacattgagctatttaaggacaaacccctgctttagtttctgctgccatggagactcttatgcgtttttcacccttaaggcagatggggtattgagttggggaaaaaaaaaaa

SEQ ID NO: 1040 - DNA, 260 bp, dog
accaggtcataaaagaaatcaaaggataaatttaaaaaatagctagaggggcgcctgggtggcgcagttggttaagcgtccgacttcagccaggtcacgatctcgcggtccgtgagttcgagccccgtgttgggctccgggctgatggctcagagcctggagcctgtttccgattctgtgtctccctctctctctgcccctcccctgttcatgctctgtctctctctgtcccaaaaataaataaacgttgaaaaaaaaaa

SEQ ID NO: 1041 - DNA, 183 bp, dog
cgacgctgcagtgaggttgtatttgatctgctttctttcatgcaggtgacgtaggcggacagcttctgtgtcatgagataatctgtgatcatctatgccagtggttgcatagtgtctggttaaaaagggccaatggttacaggtttagagccagagtctctaggtagctttagaaaaaaaaaa

SEQ ID NO: 1042 - DNA, 184 bp, dog
gcctttatgaacagttaaatttctagtatttatatttaggattaagattatttacagtagttttattggtaaagggctaagaaaaaaagccactatgcattgtataaccaatttatagtgaatcttaacatcacagaagtttttctgttaactttaacagaagttaaaattctaaaaaaaaaaa

SEQ ID NO: 1043 - DNA, 193 bp, dog
ctagattgccttttattctttgggtcatcttagcattaaaatatgaggacagaatgcatcagagaggctagcagagcctatagggaaaaacacctgtgtgggtgtgggtactccagatcctaatcttaattgttaccctgggcaagtcactttgcgtctctgtacctcagttttcaatctgtaaaaaaaaaaa

SEQ ID NO: 1044 - DNA, 119 bp, dog
agttatcatgtatcccagtaattcaaggctattgtaattcacagcattaaaagactgaagaataaaaaccattcaatcatctcaatacacacagaaaaaacatttgtcaaaaaaaaaaa

SEQ ID NO: 1045 - DNA, 213 bp, dog
caagtttccatgggacatccagctggagctgaacagtggggaggtgaatgcagtttgcatttctgtcatttctggctgtttttcagagtccctgcatagcatctgtctctatcaaacttctccatgttggaaattagcagtgtctactgggatacagggttttggactctgttccatacctaattctgaagcaaatggttacaaaaaaaaaaa

SEQ ID NO: 1046 - DNA, 185 bp, dog
ttattcgggaagataatcctgaacttgcatttataaaatataatttgggccagtgggaaccgactcatgtggtcactgaaactaactcccagaagagagaattactgaaaaatggtacaacccatctagtacccttctaattcctgatatttgcaggatgtgccttactgttccaaaaaaaaaaa

SEQ ID NO: 1047 - DNA, 295 bp, dog
gttataggtctgggataaggaagtacggagttgacagttaagtatttagtaacttttatggctaatggacagacaagtatgtgccgtgagcctaaggattagaaacacaggacttagacatatatgtaaactctttactgtgtttttgtaaacatgctggtctatccacaacagcctggacataaagggtgggtagtttaccaggatgtgagcatgaggtcacttctggcttggattatctggcatgggctcaggggtcactcaaatttctcagccccccccccaaaaaaaaaaa

SEQ ID NO: 1048 - DNA, 579 bp, dog
ttaccgctgctatctgatactgtactgaaaggtctaaccagaggaatgagacaagaaaagggttgaaaaaaaaaaagtaagctgtattcaaagataatatcatcctatgtatagaaaattttcgaaaggaaggtgcatgaacgtataaagaaatttagcaaagattcatggtaaatatcaacacacaaaaatcacttgtgtttttataattcagcaatgataacttgaaaaataaattaagagagcagttatatttaaatatcatctaaaataatgcaatgcaaaaatatctaggaatatatttaactaagaaagtgaaagacttgtgccctgaaaactatcaagcatggctgacaaaggctaacaaagactaaatgaatggaaatatgcccatattcatgaataagaaaacaactttattaagatgtcaatactactcagtacaacccccatcacactctccctattagtcagattcaccacgctgtcaaaatgtcaacagccttttttgcagaaatggaaaagttaatgctcaaattcattttggattgcaaggagtaccatatagaaaaaaaaaaa

SEQ ID NO: 1049 - DNA, 187 bp, dog
caagaccacagggaatactttgcctgggaaatttggcggggagtgaatagagaggacattttacatctgtgttttgttctctggaaaatctgctgggacccattgatgtgctgacttaagatgggacactcctccctgtgtcactatagtacctgcacttggtgttttgactttataaaaaaaaaaa

SEQ ID NO: 1050 - DNA, 412 bp, dog
gttgtgcagagtagaatagggcagtgactgcgctcttatgaaagcattgttggagaagaagaagaaacgtatcaggactgtggaaatctgttttcaagaatgttcctgaaacacctgccgcttagactttgttactgatcccggttattttccttgcatttggggaaaatacctctcctatatttcactataaggaatggttttgcaagaataagttatgaccaagacaaaccgccagtacaagacccccactgataccaattacgtgagaaaaagtagtaacatccaatttaggacacaagatgtctgaatcgtttggactgaaagcctactgagagaaccctggaggttccactttgtggtctgtccaagccagtgttcaaaggctaaatttttagtgtaaaaaaaaaaa

SEQ ID NO: 1051 - DNA, 483 bp, dog
tcctggaattaagttattatacagatgtgctcaattttaattcctggcatatacacaccctaaagtggtcttagacaatgatgtcggtgggggaggggagaattatttattggtagtcgacttaaaatcttggatttgctttaaataacatgggtttgcacatcataaattacatgccagattgatgggagtcgagaaagttagaagtaaagcattaagaaactatccgtggggggaatccctgggtggctcagcgtttgagcgtctgccttcggcccagggtgtgatcctggggtcccgggatcgagttccgcatcgggctccctgtgtggagcctgcttctccctctgcctgtgtctcagcctctctctctctgtctctcatgaataaataaataaaatcttaaaaaaaaaagaaatagagataaggagattctcaacacaattgtagaaaaatcagtctaagaatgtgtaaaaaaaaaaa

SEQ ID NO: 1052 - DNA, 297 bp, dog
acggggtgggtcccagggcagcaggaagaggcaaggcaagggagctctctaggatctcttagagggcactaatccctctcgtgaaggctcaaccttcctgatcaaatcaccccctaaaggcctcacatcctggtaccatcacattggacagtaggtttcacgtatgaattttgtgaggatagaagcattcaggacatagcaggtgtcctctctcttgctggcctcttgcctaaggattggaactgaggaatatccagcttcccacaagtatttgtatttcctccttaaaaaaaaaaa

SEQ ID NO: 1053 - DNA, 306 bp, dog
gcctttagtaggaaaaactgtaaggtaaatacttgagaaatatatgcagaagaactctgtttggtttccaaaagaaattaataacacgacatgtgattttaatatctcctatacaacagtcttaaaaaactgtttcttcttggttcactttttgcctaacactgtcagtatgatttaatttttatacagtttattgatcatatggtctggattacagggcactaatatattaaaaaagagaaacatagttttctgtttattctctcacagaaatatgtaccaagcttgcctttagaaaaaaaaaaa

SEQ ID NO: 1054 - DNA, 303 bp, dog
gcctttagaaacactgaatttagaagttggagagaatgaacaaatagtacagatttttggaaataaagtggaacatgtagaagaagttaagaaagaagctgaaaagtctcccaaaggaaagggaagacgaagcaaaacaaaagatctttctttagaacttataaagatttcatcgtttagccaagatgaagcaggaagtgaacctcatatagaagctcaaagtctagaattttcttcgttagacagtaaaaacttttcttctactaccgaagatgacactgaccaatgtgcgaaaaaaaaaaa

SEQ ID NO: 1055 - DNA, 246 bp, dog
tatttatgagggcagaatagttagcaaaccagaaaatccaggctatatgcatgccattaactatataaaaggaatgatgcatatgaatacatgagatggcttgcgtctttcagctggccagtatgtataaacaagttttgagaggtcaactaattgaaagtcactgtgcattctgctctctttgcagttgcttatttaattgatgtcgactctcttcattagctcagttaatctgaaaaaaaaaaa

SEQ ID NO: 1056 - DNA, 255 bp, dog
ccagtgcacttgccattcctatgtccctccccagcctgaagggttggtgggaccaataaataatattggaagaataataaatattgggaaaaaagaaatattggaagcagcattttaaaatatgtaggaagaaaaaaatataataaacgtctttcatgaaggtgtttagtggggaaatgagatcaatgccagtttgattttgttttcaagaatttggtctttgttctttggtgtagcaagagtgaaaaaaaaaaa

SEQ ID NO: 1057 - DNA, 337 bp, dog
gtcagcccacacccctccgtccgcttcgagttgatcactccccagtgcccctgaacctggaaccgttcttcttatttttgacatcgtggattaggctggacggttttttgagtaaatttgtatgagcaaaaccatgacaaaattatgacttcctctgctcagcatcgtgattttgagatttagccacgtggttgtatgtggctgtactttgttttcttcaggacagggttgcctggtctactactgatgttcacgaggctgattccagtatggagttattgcaaaaaacaatatgctgttagcatgatcatctatataatttgctgaaaaaaaaaaa

SEQ ID NO: 1058 - DNA, 237 bp, dog
gtcagccatgaaagtttttcttgcctgttttttcagtcaataaaatgattactagaaacacatcgttcaaaacatctcctggagttaaaaaccacacatttgaaaattccagccaaatgtcatctgtccaacatgtttttacatatttttagttgctgaagaattatactagccaaaagaatcaattatttctaaagcaggaaagagaacagtgaacgtatgttggaaaaaaaaaaa

SEQ ID NO: 1059 - DNA, 260 bp, dog
ttgaggtcacctacattcttatcacagaattgccactctttttttagaaaaagaataccagactgaatgacactattttaaccagacatttatggtatatttcaccattaactccaaaaaggattagtttacactaggcatttttatctggatccaaaatagccagtgttaattatggctctagttcgtatttgccatttagcctacctaaaagtatagcgatttatttggttctattttgcatctgtgaaaaaaaaaaa

SEQ ID NO: 1060 - DNA, 156 bp, dog
ttgaggttgataggtcgtcctgctataagttcatttgagtagcagacctgacaaagcttttgaggtcaaaaccctaccatgtgtaattaaaaaaaaaaaaaagaaaaaaaaaaagaccatgttaataaaagtattcatttgcttgaaaaaaaaaaa

SEQ ID NO: 1061 - DNA, 444 bp, dog
atgaagggatggttaccaatatcacaatatactcagttacaccactgacttgtttctacgtgccagccactgccataaactatctgcacatattatatcatttagtgctcagagagttcctattaaataagtgctatcatatttccactttacagatgagacaactgaggtttagaaaaaaataagtaattcatttaagttcatgaagagagcaaatgtaatcttaggaagcctcaaaatattctggttgaaaatgtggggaaaaaaatgtcactctataagaaagcacaaaattacatgaaaatattaagaagtagatcaacatatttaccattttgtaacattttaaagcttcaaattgcattttattagcatattttggattagagaccctgtttttacaaaaacacaaataggaaaacaaaaaatggggaaaaaaaaaaa

SEQ ID NO: 1062 - DNA, 278 bp, dog
atgaaggtaattgtccacaaaggccatctgctacctggcaggtgtccatgagtcagagagagagatggagactaaagtgtctccttctgttaccatgataacagtttagctcagacttgcagttgaggctgtgtgtgcagaggatacagttatcaatgctccatagagggtattaactcaacatcaggctttgtgccactttgggcttgattacctgactgtaacatgtactaaggagatatgaaaaaaattcttatctgtcccatgaaaaaaaaaaa

SEQ ID NO: 1063 - DNA, 246 bp, dog
atgaaggtatgggggggaaagagaagataccagcatttctgactatatgctgagtcactttgctaggtgctttacatcctcacagcagcctgtggagtaggtgttcctatctctgtttttacagattggaaaactgaagcaagagtcgaaatagcttgcccaaggttacacagatagtatgtgacagtactgcctcatccaaatgacatatactagggtgattcaaaaagtggtgaaaaaaaaaaa

SEQ ID NO: 1064 - DNA, 523 bp, dog
atgaaggcaaacttgtcttggccaatatttctgattccttgttcaacagcattagtattttttgttgctgttgttgttcttattctttcaaacaattaaagagccacctggtgatagcctgccttgcctcttatattctcctttatcctacctgctgtggtgtttgtgtgggatcacatggagtcaagaagtggatgtcttataaaagatgccaagaaatgtcaaaaagactaatgtagtgggagagatggttaagcaaagaggggattccaagatcttacttgttagcagtcttcttgcgtgttttctgttaaaggttcttgacttctgtcatgtgatatgggtttttatggcgatggaatggctttaagcaattctgtggagggaaatgggaggatggactctgaattatatacatgtacttcttggaacaaggcttgaaatgctgcattttcttgcttccacaaaacttgtgggctggttaataaatgttcttaagatactgcaagccagaaaaaaaaaa

SEQ ID NO: 1065 - DNA, 408 bp, dog
atgaagggcaaagaagaggagtttaaggcactggaagatagacttgagttagaaagtgctgcaaaattagcagaactgaagaaaaaagctgaacaaagaattgttgccatcaagaagcagttgttatctcaaatggaagagaaagaacagcaatataaaaaagacacagaaggtcacttgggtgagctaaatacaaaattgcaggagaaagaaagagaaattcaggtgttggaagaaaaacttaaatcagtggaaggtctaccacagtcagaagcatcagttgtacccacatcagtaaaatacatggtagcctgtgctgagcaaggaatagatcccgaaagctctgtgcagaaagcatatgaagaaaatatcagtactttacaaagaagtctaatggaaaaaaaaaaa

SEQ ID NO: 1066 - DNA, 323 bp, dog
atgaagggactgtaaaaacaaattctagtgcctccacaggatggaataccatggaaccattaaacatcatgtttctaaagagcattcacacttgcaggtgggaaaacaatgctcatgatcacttgttaagtaaaaaagcaggtaacacaaaccacacgtgccataaagcctatttaaaaagtgtactgcatgcaaccaaagattactacaggtaaatatactaacatcaaaacagtcattgcttctgattggtgggattagggatagttcttactttatccttcacattttctgtatcattttcattattggaaaaaaaaaaa

SEQ ID NO: 1067 - DNA, 266 bp, dog
atgaaggaaatgcaaatcaaagccacaataaaatatcacctcatacctcctagaatgaccattaaaaagagggaaaaaaaagacaagaaataacaagtgttggtgagaatgtgccaaaaagggaatgcttgtgcactgctggtggtaacgtacatgggtgcagccactagagaaaacagtatggaagtgcttcgaaaaattaaaaatagaactaccatattatccagtaattttacttctgattatttatgttggaaaaaaaaaaa

SEQ ID NO: 1068 - DNA, 165 bp, dog
atgaaggcctagggatgggggtggggacccattgctggaagatggcaccatcgtggctaccctcactgcaacaaacagggagcttggcacccggctccaagaggtagctgccctagaggggctcagaaaggacaaaataaagtgtgtgtggtggaaaaaaaaaaa

SEQ ID NO: 1069 - DNA, 154 bp, dog
atgaaggccaccgatgggactgtgaaaattgataacattgcagtcgggggagaaaatgtctatcgggaaagtttcggataaagctttcttttactcaatctgtcctatatggttctgaaataaatttgtgtttgattccttggaaaaaaaaaaa

SEQ ID NO: 1070 - DNA, 291 bp, dog
tgcaccgttaaacagagctgtcctatgactcagtaaattcgctcctagctgtatacttaagaaaggtgaatacatataaccttacacagacaaaaacttacacacagatgttcataacagcatattcacaaagccaaaaagtggaaatgttcaaagacaaatggataaataaaatgcaatatactcatttgattataaaaaaagaaaacaataacaagcaatgaggttgtgacacatgctaccatctgggtgagcctgaaaacattatgcttacagttggaaaaaaaaaaa

SEQ ID NO: 1071 - DNA, 232 bp, dog
tgcaccgcctgcatcgtgagtccttctaaaacactccctttaaaaattcttccttttggtgttgtcctttgggcctcaggcagtccttgggggcctgtcactgagtgttcgtgatgacaccgtgtgctccctcttgttagctgaagccctagcacacccccagatctctggacctctgaggtcatctgagcacagggaaaggacaaccgtggacccatcagaaaaaaaaaaa

SEQ ID NO: 1072 - DNA, 200 bp, dog
tgcaccggaccgggggttctgcagctaaacctggaaaaccaaagggaaagaaaaaactttcttctgttcgtcagaaatttgatgtaggttgttattcaatagatcttggtaacaactgatttaaatgctgatgtgatgaaactggccttagtttttaaatacatcttaaaatactagtagtagagttggaaaaaaaaaaa

SEQ ID NO: 1073 - DNA, 172 bp, dog
tgcaccgtacttgtcaagtggctgtgtagcctagccctcctctgtccaatactgtaaccatgaaaattcatggctgttgtgcacttgaaatgtgtctagtctgaaatgagatttggtataagtgtaaaaatacacagaggattttgaaaagacttactttgaaaaaaaaaaa

SEQ ID NO: 1074 - DNA, 198 bp, dog
ttatccgacttcagaggtctacagggaatattttgaggcctagatttatggggctgtacatagtatctgctaccaaaagaacattttgccatcaggctcattggaaagcatcttgtctttctttctgttatactgttgtgagcagatgttccctcagcattttggaatcattttaatgcacaagatggaaaaaaaaaa

SEQ ID NO: 1075 - DNA, 165 bp, dog
ctccggagtagagagatgctcaagtgcaggcctttacaaagcagcctgatagggcagctgccacattaacaacataagtagaggaacgttctggaaacaaactgggttctaattgtagtttcaggtgttttcattccatttttgagcttgtattaaaaaaaaaaa

SEQ ID NO: 1076 - DNA, 324 bp, dog
ggctgaccattggttatcctccctcattagctaatggaaacaatttgactaggaatggctgttactggactggatttggaaactgctacaaccccaaaagtataagcattgtgagttcatgttttgttttggtttctgctttagatggttcaacttgtagttttcccaatttttttttttttttttttagttttcccatttttaaaagtattgtcctattttaggagagttacaaatgataaattaaccccttatcagggctttagagcttgctcctcaaacttcctcttctatagatttttcaggattttgtaaaaaaaaaaa

SEQ ID NO: 1077 - DNA, 198 bp, dog
ggctgaccataagtttcctttaaattaagtaatatgaatgatttgaaaattaaatgagatagttcatataacacttgaataacaaatattcatgagtttatgaatttatacgttatacaaaactcaggtatagtaatcaccagagacaacagactgagtataaagttattttattagtttgcatcataaaaaaaaaaa

SEQ ID NO: 1078 - DNA, 312 bp, dog
ggctgactcagtgggtgaaaagtgcaactcgggatctcgggttgtaaagctgggtctcacattgggtacagagattacttaaaaataaaatattttttaaaaaaggaataatagggatccctgggtggcgcagcggtttggcgcctgcctttggcccagggcgcgatcctggagaccggggatcgaatcccacatcgggctcccggtgcatggagcctgcttctccctctgcctgtgtctctgcctctctctctctctctctatgtgactatcataaataaataaaattaaaaaaaatattaaaaaaaaaaa

SEQ ID NO: 1079 - DNA, 171 bp, dog
ggctgacatacatttactggggttgactagattatataattgctgttttctgtctcgaaccactgtgattatgactcaatgagtggatacatttacggtgctatgtaaataataattattttaattatggtttgacctgtacaatatattctaacaacgtaaaaaaaaaaa

SEQ ID NO: 1080 - DNA, 428 bp, dog
cggtcctccaaagattgcctttcatctgcataaacaatggactttatataactcgattcccctacggagttccttataatggtctcaaagagtattcttgacttctgaatgctttcaatgctgctgagaagcaaaaaggacttgataggaagtcagagagggcatcaacatcaaagtagcttattcccttcctgcaatggtaggaacagcaggaccctaaggcatttcttacttcttatccaggtcctgtcgaaaatctcagccgatcacagcagtgaaagtggtatgaatagggtgattcctctgcatttttggagttaggctcttgaaaacgctgtcagagaaatttacatgtatgtccttaatcccttaaatgggaagtacctaataaatagggcttggtttggaacttggtttaaaaaaaaaaa

SEQ ID NO: 1081 - DNA, 376 bp, dog
cggtcctatccactttttagtttcttatttcctatatgtcaaatatacagcaaacactcttcaccaacacatttcaatgtctgctttgttttgctcatttccattgttgtccttttctctggacatgcggctagtcacatttcactctctacgctcagcatagctctactaaatttgattatgtgcaaacatacaaaaacaaccaaaaataatttatgcccgtgttccacaattactcacagctgggatctaatcatctcaggtatgcacataaagttttgggattcatatcacatgccatgactgatgcttaaggtgagtgtgtttctctcagaggtgtcaactaagagaaaagcagtgaaggttaaaaaaaaaa

SEQ ID NO: 1082 - DNA, 154 bp, dog
gaatgtttttagaggtagattcttccttagagccaccagatcaaagcctaggccagccagcaccttgatttaggtttcatgagccctgaacagaaagttcagccataccattccaaacttctgacttataaaactattagattaaaaaaaaaaa

SEQ ID NO: 1083 - DNA, 186 bp, dog
tgagactggcttattatccccattttacagatcaggaaacttagagaaggtaaatttaaatttagagttgcagagctctgaggtggcagagcaggaatttaaacccaggtgggtctgtctgactgcaaagccacactcattccatctctttcatcaaaaatgtaacccatcgtttaaaaaaaaaaa

SEQ ID NO: 1084 - DNA, 169 bp, dog
tgagactagagagaatctttttttttttaatcttttgatttgttttcctttagttcaaaagttgtgttataattgcctctagcaaattttcgtatgtggtagtatagctttaatttatcgtaactattactatgctgttctgaattttcttttggtttaaaaaaaaaaa

SEQ ID NO: 1085 - DNA, 303 bp, dog
cgaaatgcactgagaatgggtgttcttcacctcagtgagcttgtggactggttaggcagggcagctgtgtcacaaagcttgtaatgataccctctgaaaagttacataatacatacatataggggctctgggtggctcagttggttaagcatctgcctttggctcaggtcatgatcccggcatcctggaatagaaccccacatcagactcccggctgggcagagtctgcttctccctctgtccctcccccttctcatgctttctgtctctcaaataaataaataaaatctttaaaaaaaaaaa

SEQ ID NO: 1086 - DNA, 487 bp, dog
cgaaatgatcatagccagaaatagaggaaacatttaacagtcttagatgtctggaaaatgtctagcttctatgtctctgcgcaatggggggatttctttataatttagactagacaggaaaccactctgacactactagaagggggtagtatcttcagttggacgaatttagtagtgtctccattttacagggctcgttctagccatattgtgatcagaggtgaaatttgaccaaattgacaaagtctaaggacacttctacaaatactgtaaatgtccatacataagaacgactgaaaagggaaggacccaaatggaacacaaaaaatggtccagaaaaatttctggagagagaaatggagactaagccaagatgaggccatccaggcataatcaatttcgacatctctccatttcctccggacagaggatgtggaagatgaactatctcttatagttgtatcatttatgtttgtaaaaaaaaaaa

SEQ ID NO: 1087 - DNA, 323 bp, dog
cgaaatgggagtgtttatactttttatttgcagtccactttacctcttcttatataatcggtttctaacctcatttgacaagaagtagtgaaaagactagtacattataatttcaaggtgattgaaccgatttgtatcattgtatgtatttgtcagtctacgtgaatcatttctatatatttacaaattcatgacattcttggaaattaggatttttttgtgtattattggaattttcatcttcagtactggtcattattttattaaacattttctatgaaaacatttccaaaaattattgtgtccctgaataaaaaaaaaaa

SEQ ID NO: 1088 - DNA, 157 bp, dog
cgaaatgaaatataaaataaatatgaatgttttacaagtgtttaaatttctgggaaaaggtgcgtgtgtctgcaaatacatgcacacagtattttgcaatatctagccagaatttaaaaattcctattttttaaaatttgcttcttaaaaaaaaaaa

SEQ ID NO: 1089 - DNA, 221 bp, dog
gacctttgagaagggtttcttagaaataagtcctacatttaaacttttttctttaaaacatggtattggatgttgactttttacacagttctaagcactgttgttaatatctggaaagcattttgagagattaatggacagtaaacattctacatttaacgtgaatacacttctttttgattcagaaaataaaatcagatttttgaaagtaaaaaaaaaaa

SEQ ID NO: 1090 - DNA, 180 bp, dog
gaccttttatctttgggttctgctttgtggtttttgaagctttccaagatcaactgagcaatgatgtggtttggcattttaaacagttaatacagtatcaagctggatgattttgaaagcaattaatgcttgaatgaagtccttatcctactgagtcatgttctcccttaaaaaaaaaaa

SEQ ID NO: 1091 - DNA, 172 bp, dog
gacctttaatatttattacaaaaatacttgccaaaaaatatatatttgcacagatgcataaaggtgcatgattcattgtgtcactgttcattatggtgaaaaaaatgtcctaaagaaaagactagttaaatctgtcattcatagaataccatgcaaccaataaaaaaaaaaa

SEQ ID NO: 1092 - DNA, 306 bp, dog
gacctttgataaccgtggcaattgctaaatagaggaaacattaatgaattaaaaaagcattccttatttttttaactaatatttgcacattttcttagtatctttccaaatcttcgcctcttctattcctttgacagatggtatccctcctcctggatcattcgtttcacttggtttctaactttagatttacttcacttgttatttgacttagcaggtgcaacaacaacaaacaagtgtgcccgcccccacttgcctcttaactgaaaagcttaaaataaatttctgaaatatgtaaaaaaaaaa

SEQ ID NO: 1093 - DNA, 257 bp, dog
gacctttacaaactcctaatacatagaaggcactggggatatagaaagaaaatatgggggcacctgggtggctcagacagttaagcatctgacttttgatttcagttcaggtcatgatctccaggttgtgagattgagccccaaatcccgctcctcactgggcatggaacctactcaagattctctctctctctttctccttctgtacctctccccacctcgcacttgcatgctcagtctctctctaaaaaaaaaaa

SEQ ID NO: 1094 - DNA, 189 bp, dog
gacctttaaagttgttatgacctaatttaggaaagtcctgtagaatatatctaggaattaatttattattcacactttatgtgccgtatctgtgcataaagaaagatatcaagatatgcttatggctgggctaaatgggatagagctgtagtttgcttttccctacacccttcattttaaaaaaaaaaa

SEQ ID NO: 1095 - DNA, 400 bp, dog
gtagtaatcaaaatagtgtggtaatggtacaaaaatagacacatagatcaatggaagagaatatagatctcagaaataaacacatatttatgtggtcaattaatctatcacaaaggaggcagaatatacatttgggaaaagataatttatttaacaaatagcattggaaaaactgaatagttataggcaaaagaaaaactggaccactttctcataccatatacaaaaataaactcaaaatgaactaaaggcctaaatgtgagacctgaaactataaagttcctaaaacataggcagtaacttctttaacattgtctgtaccagcattttctagatatgtgtcttgaggtaagggaaacaaaagcaaaaataaactataggggctatataaaaaaaaaaa

SEQ ID NO: 1096 - DNA, 271 bp, dog; identical to SEQ ID NO: 379

SEQ ID NO: 1097 - DNA, 426 bp, dog
tcatatgtatacaaaggtacagagagcaatacattttcttgcatttgtctctacgccagcacatccaaaattttactgtaacactctttgttgcaggaaaatatagaaaaaatacccagcaatgggtgacggtaatcatcacggttcacccatgcagtgtgatactgtcttagcctgtttgggctgctgtgacaaaatactacagatgggcagctcgtacacaatagaaattcctttctaatactcttgggagtgggaagtccaagatcaaggtgccagcatggtcaggtaagggctcttttccagatcgcagactttttgttgtatcttcacatggcaggaggagcacaggatctctgtgggatctcttctatataagagcataaatcccattcattaagactctacccttgtaaaaaaaaaaaa

SEQ ID NO: 1098 - DNA, 305 bp, dog
tcatatggtaggaaccaaaaaggaaactttcctttaattccctttttacactttatggtaagtagcagggggaaaaatgcatttatagatcatttctaggcaaaattgtgaagctaacgaccaacctatttctacctatgtgccgtctctttattttactagaaatgggaatcatggcctcttgaaaagaaaaaaaagtcaccattctgcatttagctgtattcatatattgcatttctgtattttttttgtttgtattgtaaaaaattcacataataaacaatgttgtgatgtaaaaaaaaaaa

SEQ ID NO: 1099 - DNA, 317 bp, dog
tcatatgaagaacagattaaaggagttgaagcatggagttgggtaaagaattcaccttagtaagaatcaatggaattgctttgaaggattggtgtgaacagagacttctatggtctggtgaatattagacattgcaagctttgagagaagactgataattatggagcactgagtaagaatgagcctatgaaagggggaggtcaaaatggcagatgggttgtgtgtacatgatcatgtacgtgagtatttacttaaaagtctgtagcaaattcacttgtaagaatcttaacataaattaaatcctgtaaaaaaaaaaa

SEQ ID NO: 1100 - DNA, 328 bp, dog
agttgctataaaaattaaatgatagggcagcctaggtggctcagcggtttagcgcctgccttcagcccagggcctgatcctggggacctgggatcaagtcccacttcgggctgcctgcatggagcctgcttctccctctgcctgtgtctctgcctctctttctctgtgtgtctctcatgaataaataaataacatcttttaaaaaaattaaatgatatatgtgaaaatgccttgaatgtgacaattgctaaataagtattcaattctttcagtcttctttctggataaatgtgctaatcaatacatcacaatattctaaaaaaaaaaa

SEQ ID NO: 1101 - DNA, 168 bp, dog
agttgctggggagaggtgaaggagtgggcgtgtaattagtccaatccattgaatgagagaaattacaggaattgttgtcagttctttttctagacagcattttgatatatgcagcagcaaagtatactgaagtggcatatatttatacaaaagtagtaaaaaaaaaaa

SEQ ID NO: 1102 - DNA, 140 bp, dog
agttgcttggtaaggttaacatattctctaaaattgctaataaaccagtcttttgtttgaacatttccaccacaatctcattttcttggggaaaggtgcttttcacatgtgaagaaaatataatcattttaaaaaaaaaa

SEQ ID NO: 1103 - DNA, 356 bp, dog
gcaagttggatcaatggcagggtcctttaattaagaagtaaaatcttcaaccagattcaactcagttgggcaaattgaattgtaccattctgctacactgcagatgttaaaattattttaagctctaaaatcctctgatttgcttttattatttaaaatgtgttgactgaggggtgcctgggtggctcagtcagttgagcattcaacttttgattttagctccagtcatgagctctctgggttatgagattgagctccaagtcaggctctctgctggacatggagcctgcataggattctctctctccctttccccctgcccctctttcactctttcccctctctaaaaaaaaaaa

SEQ ID NO: 1104 - DNA, 263 bp, dog
gcaagttgggacactgagaagacagccatgttcgcgttcaatatttcccacatcagtaacaaggtccgaatcctagagctcctcccggccctgacgactctgacaaatcacaacaaatacttgatcgaatctggaaatgaaaatggcttctttaaaatcaaccaaaaggaagggatcagctacctccacttcaccaagaagaagccagtggctggaacctattcattacaaatcagtagtactccactttataaaaaaaaaaa

SEQ ID NO: 1105 - DNA, 330 bp, dog
gcaagttgaaggcgggcctgggggaaagggagcaacacttccagtcacaacttctggtctgaagatactgtaggacattaatgggagttgtggtgcgtggagggcctacctgaaaagtgttccatgggttcagatgaactcagcaagggatgcctgggtggctcaacagttgagcgagtatctgctttcagctcagggcatgatcccggactcccgggatcgagtcccacatcgggcaccctgtgagtagcctgcttcttcctctgccagtgtctctgcctctctctctgtatctctcatgaataaataaatacaatctaaaaaaaaaaa

SEQ ID NO: 1106 - DNA, 230 bp, dog
gcaagttgttgctgtgtcttgtgcaagtaatctctaaaaaacccccataactcctattgtcgtgatattccttgccctaatagtaacgtggtacttgacattaatgtccctgaccagtgtaagtacttgtagaactgctctgtcaaactaaacaaggatcgttaagtactttagtattctgtgtgctcaaaggaaaaataaagtctgtcagtctgctgtaaaaaaaaaaa

SEQ ID NO: 1107 - DNA, 222 bp, dog
gcaagtttgaatgtagaaatcaagttaaaggtagaaatcagtatttccttggggctaggccgactgtcccaagtcaatacggttactgtgctttatctgtggttgtagaggatgaccacagagtcagccgatgtgagctgactaactgaaccagactccagggctgtggttggagtgatgcattctaagaagagagggcgttgcaacatataaaaaaaaaaa

SEQ ID NO: 1108 - DNA, 438 bp, dog
ttatccgcattaactcatttccttctcatggaaacttttgaagtagtttcttttattatctccattttgaagagggaggaaccaagactgtggaaagatatatatcttgcccgggccacagctagtaaatggaagacctgaaattcaaagctaggtaactggacaaaggactgtgcttgacttcactttactaatttatggcagaggcagccttcaatcccagattggtctaagttgaagtccatatactctccataatcctctatgaaacccacagcaactctgaattctcttctggctttgccatgagtagaaactggttaacgctgaaggatctcaagaaactccccatcaacaaagattctgttcttgttgttgttgttgttgttgttgttgttggaatctatgcccatcagtataatctattaaaaaaaaaaa

SEQ ID NO: 1109 - DNA, 375 bp, dog
catatgccaaggacagatttttgaaggggttagtaaatattttcgttagctccttttatgggcatgatggtaaaagaataaatacatccaattaaagctcacacctagggcagggaacaaaggaatgctgagatgcttgcaaaatgtatgaatgtacttctataaccagatacttctgttcaaaccttgggatgttgtaatagtcggtgagacactaatgaagatttagtaggaagaccttggcagagtatttattaaactatatgccgtattgtaccattagcttagtaatactgtggaatcagctaaaactgtatcacatttttaaaattagccaaaacatgaattgaatatgtggtcacataaaaaaaaaaa

SEQ ID NO: 1110 - DNA, 131 bp, dog
caagaccaatctataaaaatcaacatgttttatgaaatgcatgttactttttttttccttttggtacctgaagattcccaacagaacatacagaaagtttctgcaacacaaatactctttaaaaaaaaaaa

SEQ ID NO: 1111 - DNA, 197 bp, dog
gcctttaaaacaggacacagttgtagataaaccatgtgactcctacttaataaaattttaaaatataagtatgaatataaactttaaagttttgattctacatgtgatgactaagatctatttcatatactgcttactataagaaaaagtggtgtttaattttccaataatgataattctcattataaaaaaaaaaa

SEQ ID NO: 1112 - DNA, 298 bp, dog
gcctttaagggggggagggggtattctctacacattttcttttttaactttgcactttctttatataatagtttgcattttggttatttgctaccctggatactttcaggaagaatgaattaaatattcagggtgagtgagttaggtataagatctgaagttttcagctgtgaaaacaggaaaaatatataacattttaacttgactgtggaaaatgacggttgcatgtttctaatttgtatgtttccatctttgtgataagatgctttaataaatctcttaaatattaaaaaaaaaa

SEQ ID NO: 1113 - DNA, 302 bp, dog
gcctttacgtgtccttttttgtggacttctctctttggagatttttcccagtgatctctcagcattgtttttaagttaactgtatttgacttgtgttctcagcattcagagagcagcagtgcaacacggctctgctgcccttcctgcatcttctggcatcatagctgtctgagatttgtacatgtgtaaatagaagttcctggataccctaaaaccttggattaaacagaatgtgcattgtacatctttaagcaaaatgtatattaatttattaaatctagttgtcactttaaaaaaaaaaa

SEQ ID NO: 1114 - DNA, 285 bp, dog
gcctttatgtaagcagatgagcagacggctgtttaactcattactttggttgatgtgtcatatatattttgactaaaaattataggaagttgttcctctgagcgagtcttttaggggtggaagcagggggatagcaatattgcctcagattcaaactggcatcaccataaaccctgaataccagggtgggatggagtcagccttttatagttgaaatacaattttttattcaccactgtatgcacaaatccttgaaaataaaatttctttccctaaaaaaaaaaa

SEQ ID NO: 1115 - DNA, 242 bp, dog
ctttggttaccacagcaattcaaaaaacatcttcattatttgtattaatggcatgttacaagttagagatctgattcaactttttcctaaaagtaaaatcactgtataggaaagaaattcctgctctctggataaatcataaaaatgtgacaagattctcaggttaagtctgaaagacaagttctaagaatgttttgaacaaacgtttttggtctttatatattctctcataaaaaaaaaaa

SEQ ID NO: 1116 - DNA, 189 bp, dog
ctttggtcacatacaaaatcttttaagttatctaatttgtgtttgagattaacagaaacctccagaaacaaatttcactgtgcaatccacataaaggatgggccacaactggcccgtcatcttatccttattctacacttcttcctgccgcagttttgccatttcactgcacgtaaataaaaaaaaaaa

SEQ ID NO: 1117 - DNA, 176 bp, dog
ctttggttaagactggtaatataagaactcttgctagaaggcttaaaatttacaattaatactttttttagctattaaaatctaggataagctgataggatgatctgcattcataacaaggtatactcattatatagtcagttaccgaaaaatgtgagccaagttaaaaaaaaaaa

SEQ ID NO: 1118 - DNA, 253 bp, dog
aactgagaccaaatccaatgttcttcccactataggatgatggaaagatagttttgttatctaatttagactatttacattcactatacatgacaaattgcctatttgacaattaggcctttataattctgtgttcttctgcaccaatgaaaaatcgtgagtctaactgaacactggtctgtataatttgctctaagcactagaatatgtctaaagaaaatgggatatagtggggagtgtttaaaaaaaaaaa

SEQ ID NO: 1119 - DNA, 271 bp, dog
aactgagccacccaggcacccctcatttgaaatatttaaagcacacaaataccacatacaatctcactcccctcatgactcataggtcagatgattccaagagacatttatatgattgtgcttattttgtaaagaaatagttttgcataaaaggatacagaaatgacaggaaaagaaagaatgaagactaactgtactaaaagataaaaaaggaggtagggggatataacttatgcattaatcttttctattaacagtttaaaaaaaaaaa

SEQ ID NO: 1120 - DNA, 272 bp, dog
aactgagcacaatcctggctaccctgtttaattgttgtttttatttaacaagtgcttgctgaatgctggctgtgtccaaggcactgttttaggctatcggttgaagataaccaagacaagtaagatccccacttttttagaccttctattccagtgaaggaagagtttaaaaacaagtcaagatataccctattaagctgtccccttacaacaggtaagggtaaattttatggtctgtaaattatatctcaaaaaggtgttaaaaaaaaaaa

SEQ ID NO: 1121 - DNA, 144 bp, dog
agttatctataaaaaaatctaaaaaactggaatgctttttttcaaattgatacctaaatatctcagaaatctctaatttgaagaaatcttcccaattgaatgctagaattcttgcataagtcttcttgatgttaaaaaaaaaaa

SEQ ID NO: 1122 - DNA, 228 bp, dog
tcaaagacgactagcacagaaccctcccttttggaaaacataattttaataaaataatttttgatggattccgaaatttgtcatgttttgaagagaaatgcctccatttaaaagtacgaagtcaaaaggatcatgaagcctaagtttaagaactacttattgactgaaacttaatgaaactctttataaaaaattaaaaacatggaaaaatgaaaataaaaaaaaaaa

SEQ ID NO: 1123 - DNA, 143 bp, dog
tcaaagaagaaaataaagggatataaaaaacattttgacagatgaaaataaaaaggcaaaatatcaaaatttatgggatgcagcatagttctcagaattgtcaactatatttaaattttagaactttaacttaaaaaaaaaaa

SEQ ID NO: 1124 - DNA, 267 bp, dog
gtagtaacatcatatcataaaacaacagagccatgataaataactaacataagtgctctattacatgcttaagcatctgttttttcaaaaaaaaaaaaaaagaatctgagcatttctattttttttttcttctgctacagtatgggaggaggtggtcaaattttcaaaaatccataaaatagatctatcctaaaacttaccaacaatttttttccctagacaattctcctaccagaaagccttgtgtaggtatgataaaaaaaaaaa

SEQ ID NO: 1125 - DNA, 369 bp, dog
tcaaagagaaacatggttacctataagtgcaaacaagatttgcacttagacttctaatctggagcatggaatgttagataacagtggagcagtgtttaaaaagtacttatgagacatattttgaactaagaaattatacctatcattcaaagtgggggcaaaataggggcctctgggcagcacagtcaactaagcttctgactcttagttttagttcaggtcatgatcttggggttctgagatcacgccccatgtcgggctccgagctcagcgaggaatctgctagagtttctctctccctctgcctcaacccatgctcactcactctcttattcttaacaaaaaaaaaaaaaatcttaaaaaaaaaaa

SEQ ID NO: 1126 - DNA, 255 bp, dog
gtagtaatccttattgttgcatttatttttaaaaaatcagtttaagaaatgaactagtttgtattttgaatttttacctcagtagaagaggaatttctggagaacgtagtgaaacctacaaaagtataagttgcttatgcatcctagtttataaattttctttctttttgaatgaaatacaatgtaacagattttttgagttctagaaataaaatagaaataaaagacattttttcttactgttaaaaaaaaaaa

SEQ ID NO: 1127 - DNA, 306 bp, dog
gtagtaaccagggctatatttattcctccttttgtttcctatacataattaccagcaatgtgtatgcctttgtgatcaacttcagttgtttggatttgggagtggggctctttatttggcagagacaattctgtaaatttgtatacttacaaaaataaagttataaagaatgaacaaagtaaagcttccatttaaaatgcaataacaccaatatttacttaccaccctacaattaaatatttaggttatttaaaaccagttcttgaatggcttctttcagatatacattctacctaaaaaaaaaaa

SEQ ID NO: 1128 - DNA, 373 bp, dog
ttgaggtagataacattattactatcatcgtcatcatcatccccattttatccacgaggaaacagaggcacagagaagtaaggtgatttgtgcagacctgatagctagtaagggccatgctcagcttctaaccataaggcaattcagcttctactcaacttcttttgcttttctacctcagttctacatctactccaaggcaggctcgaactctcggacttttgtagaggactgtctgagcattttcactctcctcccaattttctgaacgtctggagtttcttttgccttcatcactctccagatccttattgtttgggactgctgggaatcttctcacaggtttatctattagctccaccaaaaaaaaaaa

SEQ ID NO: 1129 - DNA, 175 bp, dog
atgaagggtgggaaacatgaattgtctgcctttgaattttgttcagtaaccaactggtatttggtgtaatattcactggatgaatgaaaaaattctgactattcctaaaaattcatactcctctaagtattaagaaagtgaccttaaaaaatgatcttgactccaaaaaaaaaaa

SEQ ID NO: 1130 - DNA, 245 bp, dog
cattccgaggccataataaagtaccagaaggaaaacgaaggtaagttctttggactagtttcactcttgtgccattacagacaaattaccaggaagtactttaaagtggggacagaaggaaagggaagtaacatcttttggacataagctctgccataaactgtgtgatgtggttttacattccttccctgtttagtcataactaactaatgtaagcctcaagaaggtatgtctaaaaaaaaaaa

SEQ ID NO: 1131 - DNA, 198 bp, dog
tcccagccttcccttactccccagcccccttttaatgatctttccatatctcagtacctagctaaatacgttcctcttctttttccagctgcctgggtgggacagagtaaggacccatggacccaggcctcttgagaattgtcaactcctcagttgatagtggaagaggggggagtaccccaagaataaaaaaaaaaa

SEQ ID NO: 1132 - DNA, 219 bp, dog
gtcagcccagaccgactcaacccaggtcatgtaggaccagtccttcacaggctaagacatataatccaagggcaggaaaacgttagttttcatagttgtttctagagaactatgagacaaatccttcaccccagccattgctatcatacattaacctaaagaagaaaggcagtgatgataagagattatcatcattagcatgacacagaaaaaaaaaaa

SEQ ID NO: 1133 - DNA, 306 bp, dog
atgaaggaaggcaacataaaagaggtaaaaatgaataaatctgtaataaaaaaaaagttagccaaggaattcacaaaataaaaggatgtagaatatggcaccatatacacttaaaacataggagaagaataaagaatgggttcaaacttaaatgaccatcaacttaatataaactgctagatgtgcaaaacgttataaaaaaaccttaataataatcacaaacacctttaataaatatgcaaagaataaagagaagaaattcaagtatatcactaaagcaaaccagtaaaccgtgaaaaaaaaaaa

SEQ ID NO: 1134 - DNA, 376 bp, dog
acggggtgagattctgcttgaattgtgttatggagagtcctgaataatgtaagatatatatgaatcagaggtagtaataaattctgaatgaatctttgggtttttactttagattactttatccttaaaaccaatgtttctataacctctgaccggaatacagaagatccaaagtacttccaagggtgagaatttttcctggcctctgtgtgagtagtttaattcattctgattgtgtggtgcaggatagaatgtgatgtgagtacatcagagatatatttacagattcttaatttatatatcaccttgccaaaatatgagacaatcctttgctgaattgtcaggagtattttcaaagatattggaaaaaaaaaaa

SEQ ID NO: 1135 - DNA, 179 bp, dog
gttggtaggggaaatggagatatgttggtcaaggcatataaacttccagttttaagatgagtaaattctgaggatctagggtacagcatggtaggtatagttaacaataatgtattatatacttgaaagttgtgagagagtagatcttaagtgttcttgccacactggaaaaaaaaaaa

SEQ ID NO: 1136 - DNA, 301 bp, dog
aactgagctatacataactacagacaaattttactatgcagtacatttttaaaaacacatttgttaatacatcacagatctcatgagaaaatctttagtgttgggaagatgttaaactcacatgagaaggtactattttaccaaaattctattattctcttaaaagtctgagtgttattgttgacagaaaaatactctcttttccttggactgacattaatttttgagaattatctaccaattacctatgtcccaataacagtgtttgtaaagcaaaatgactttctatggaaaaaaaaaa

SEQ ID NO: 1137 - DNA, 295 bp, dog
ctagcataattaatttgcccaagaagatggaatttagaaaacagagaatgcaggatatattactttgctgcattagacagtcttcctaagttgcgtcaatcctctcatctacatttttttttatgttgtctacttgtctctgtcccaactgccataaccataatacatttccttctttcttaggctaatgcagtggtcttatcaactgtctccctccactgttcttgctctgttgctctgtcatccattttccacagggcaatggtagatatctttcaaaatggaaaaaaaaaaa

SEQ ID NO: 1138 - DNA, 358 bp, dog
tcgaatcatgattttagggaaaaagaattgtttgggaactgtgaaatcaaaactccacagtgaaaaggacaaaagttgtaggtagtttcaggaaatgtgttgtggctagaactattttctacaaattgcacagaaagtttgagaagcaaagggaatgatttggttttctttgctaatcttgtttcacagatgatcacatgccaaattagtgatagggttgctattagaatatagtttactataacaaaaagaaaatactccttatcaatattttgctgcttgtgaacaaatttaaaaatgaaatacaagggttgctactttaggtgattcagctttgtgttacatggaaaaaaaaaaa

SEQ ID NO: 1139 - DNA, 247 bp, dog
tcgaatccaaatgaatctaatcgaaaaaaagtggaatcaaaaagaatcgaattgtttcagaaaaaacgaatcgaattgaatcaaatcgaatagaattaaatggaatcgattttaaaagaaaggaattcgactcgaaaagactcgaatcaagattcgaatcaaatctaatcgaaacaaaaagaatcgaatcgaatctaatagaatcgaaaagaaactaatcgaaaactatcatatcgaaaaaaaaaaa

SEQ ID NO: 1140 - DNA, 246 bp, dog
tcgaatcataaaagaagaagtaaaattatttctgttggcaaatggcatgaacttatatgtagaaaatcataaaaaggactaataaaataattcagtaaagttataagacacaaaatcaacatacaaaaatcaattgtgtttctatacatgaacaataaactatgtttgcagcacatatatctgataaggaattaatatccaaaatataaaatgaactcatataactcaacagcagaaaaaaaaaaa

SEQ ID NO: 1141 - DNA, 200 bp, dog
tcgaatcatacactttatataaaattggttccattttttaatgaaccagaataaaggattgatggacaagacaatagaaaaaaaccttgattattgataaattaatgagtgcttttaataatattagattgcccaactgtatttctttttttagttgggttttatagactgctaagtgtgtttggtttgaaaaaaaaaaa

SEQ ID NO: 1142 - DNA, 186 bp, dog
tcgaatccccccccgccccaagtatgttggatggatagagagaaggtgtaattccatcatcttaaataaatgacagatgatgtgtctgatggggtctgtcccctgatggtaggggcccttgcagcatgtagcatagcacccactaatcaattccatgttgagaggtaacaagtggaaaaaaaaaaa

SEQ ID NO: 1143 - DNA, 189 bp, dog
ttatccgaaaataagaaaaaggcagatttctactctcatcattactatttcatatcttattagaagttatagtcagagcaacatggcaagaaaaataggggtagtccaaaataacaacatagaaatagtctaaactcacctcatcctacagacacgcacaatctacagctacatatggaaaaaaaaaaa

SEQ ID NO: 1144 - DNA, 288 bp, dog
ggctgaccctgaatctacacacttgtgtatacaaacatgctgtgtattgatattttttgtcaagcatgacaatagatgtgagttgttatgttgaaaatattctgagtctcccaaatataggtaggctgctacaggttccttatggagccttcccttttcccctttttaaaacagtcactccttcttaaacaaaccttatctaatctaggataaataaaaataaatttactgtagtgctagtaaatttatagaacaccaaagaaaatgagaagattataaaaaaaaaaa

SEQ ID NO: 1145 - DNA, 212 bp, dog
tgagactctaaagtaatttaatcacttaaattattgtgatttataaggtctcatgtatataacatcattctggcaatgtatgcagggatgtatttttgtaaattttttatagcattgttacaattattaacaacaggattgagtaaatctaccttcaatatttggaaaaacatctccaaggatatttaaatagacattactaaaaaaaaaaa

SEQ ID NO: 1146 - DNA, 593 bp, dog
gcaagttccccaccaagaggtccaagaaagccggccgccactaaacaggtcctgacccagctggtcctggtgaccggcctctgccttccgccggagaaactactgaccttcccacctctgacccccaccttctcctcacagcctctgctggcgcacagagctgtccacttctagacatgtcctggcagggggacacaggcactctggcacagacccagctccacctgatggtgagagctccatcacccctggccccaccgccacggctcctctcagagaagctattgccaagacctcaagtccttcagaaccagaacagggtggccatcaggatggccacccttccataatcctcctttcctctgctccccagaccttgccatttggaaacaaacatcagatccttgccccaccccttgcttccagaaagggtcttgagcccataccccaagtctgacaccctcctcccctcccgccgcctgccaggacactctagcaggacactggtgctttgccgcataccctactgtgctgcacttctttcccaatttttcataaatataaatgtatgtatgtatgtgtaaaaaaaaaaa

SEQ ID NO: 1147 - DNA, 264 bp, dog
ctttggtccaggagtgtcctgagtctgtctggggaggcgataataccttctgagtaaaccagaagtcttcaccagaaccaaatgggaactgactctgaagagtatgatagctgcttttggtcacattccttatatctgggctcatagagatagaatttagattgggactcttctgttcttgaggaatggaaatcaaaactgcatatttcagtttttgttcttactagtgataatgaactcattgccattttattaaaaaaaaaa

SEQ ID NO: 1148 - DNA, 225 bp, dog
ctttggtcattaactcagcctcactggaccttgagtctgacagagggaacccaacacattttgataacttctcagcttttgattgatgtttttttttttaaagtttgtgaatatttaaatatttctatattactgtgtccaggtaggacatgaatatcttaattcagttaacaatagtcttttaaaagaaaaagttggtcttgagtagcattataaaaaaaaaaa

SEQ ID NO: 1149 - DNA, 450 bp, dog
ttgaggtaccatttgtcctctcagtttttagtgacttttcttttacaatagaaaaacatcacatttaacaatcaaaataacgtcacttacgaacagaaaaacttacttaaaacacacacacacacacacacatacacacacacacaaagagatttttccatcaactaacccatttcagccagctcctgggtaaggctgagaataggtacaaacccactggagtctccctcagcccttgtattcaccacatttcaagccaatagttttctcataagacaaatttcttattcaaagtgaataagatttactctgaaatcttggcaaagcctcaataagcctcagccctattctatataagatagcatctcctcacacggtccttcatgggtatagactttttaaaaatatatattagagcctactttttcagagtctggccaaaaaaaaaaa

SEQ ID NO: 1150 - DNA, 327 bp, dog
gtctaaaggtaggaagttggcatctgggatggactttgaaggattcaagaggtaaagagggtgaggcagaaggagaagtatggtaggtagatggtagccagatggccttgggttataacagagtatttgtctgctctttgtttcaggttcctggcgtagagctccagacttgagctgacatagtcaccggaaagaccactcacatgaacagaggtttagaactttgagccaacctaaaactttggacatccaaggagtagagggagctggagattgagttcaatgacatggtcagtgatttaatcaagtatgactacaaaaaaaaaa

SEQ ID NO: 1151 - DNA, 370 bp, dog; identical to SEQ ID NO: 329

SEQ ID NO: 1152 - DNA, 412 bp, dog
accaggtcctagggtactatatttttaactttttgaggaatcttcatactattttccagagtggctgtaccagttcacattcccagcagtagtgtgagagggttcccctttctccgcatccttgctaacatctgtcatttcctgagttgttgattttatccattctgactggtgtgaggtggcatcttattgtgattttgatttgtattttcctgattgtatttcactatatttcatttcttgatgccaagcgatgttgaacattttttcacgtgtctgttggccatttgtatgtcttcttagaagaactgtttgtccatgccttctgctcacttcttgactggattacttatattctgggtgttgaatttcagaagttctttgtagaacttatcttacataaaaaaaaaaa

SEQ ID NO: 1153 - DNA, 338 bp, dog
accaggtgaggctagtccccatctgtcatcatacaaagttattacaatattattgactgtattccctatgctgtacttctcttcggatcatttatttatgttgtaactgaaagtttgtacctcttaatcccctgcacctatttctccggtcccctcatcaacgcccccctccactagcagccactagtttgttttccaaatttatgagtctctttctctttctctctctctgtttttcttgttgtttgttcatttgaacacagaaaagctatattttcctatatggctgagcctgagttacgacaaaacagctgatcagtggaatttaaaaaaaaaaa

SEQ ID NO: 1154 - DNA, 402 bp, dog
agaggcacaggatctcctgggaaaaaaaaatctaatatactcagcaaaatacagtatcccattttaatttgtatttctctgaccatcagtaaagatggaactcttactggacatcttagtgcacatctgtccactaagtggcacttgcagtctccaaatgcactggtctgtcctatacaaagacttcttcacaacctgaataagttttgaatgtcccagtgaacattcatgtaggtaaaaaatacatttgcaatatctagaatctaactatatttcatatataaacacaaggcattttcttaaacagtttagggaacccaaattatatgaaaatgggcggtgggggaatcacacttcactgcactgagaactttaccaaaagctgttatctaaaaaaaaaaa

SEQ ID NO: 1155 - DNA, 204 bp, dog
agaggcaccctgtgaattgctcaattttatcattaagtaaagggaatgggaagccatcatgaaaaatcaataaaacaacatctcaaaatgtaccttgcctgattattcaatgattatgtttaacttcaattaattatgaaaattatgtagttcttactatactggtagcatcaactcattactgtaatttgctaaaaaaaaaaa

SEQ ID NO: 1156 - DNA, 375 bp, dog
atcgctctgcctgtgtctgtgcgcctctctctctctctatctctctgtctgtctctctctctctctctccttcctcagcaaccaggtctattaacactatcataaattccattttgtgtggtatattagaaagaccagaaacacagattggtcctttacaaccaacttataagagaggatttactattccaaatggctatgtccaattttattgatgaggaaacaggctgggggagtttaaaggacttggttaaggacttggttaaggtcacaaacaagtaaaggctgagtctggagcttgaacccaattttataatgcatgataatcctcttcattacccattatcatcttcattttatatttaaaaaaaaaaa

SEQ ID NO: 1157 - DNA, 333 bp, dog
atcgctctgcctgtgtctgtgcgcctctctctctctctatctctctgtctgtctctctctctctctctttgtgtgtctcccattaatgaataaagaaataattaaaaaaaaaaagtcaacttctaactttttaaaaataaaggcagcccgggtggctcagcggtttagcgctgccttcagtccagggcgtgatcctggagactcaggatcgggtcccactttgggctacctgcatggagccttcttccccctccacctgtgtctctgcctctctctctctctctctctcatgaataaataaagtcttaaaaaaaataagaagtaaaaaaaaaa

SEQ ID NO: 1158 - DNA, 325 bp, dog
gttgtgctcatagggaatatggagttcaaaggcaaaccagttagatgcccagggacgggtgatgtatttaaaatgatgaaagttctagcttgacaatgagggggacagcattagtggaaataatgaatttagaaagaggagcatgtttcaggagagacatccatgagtttggcttaaggattatcctggtttctctttcatgctaagaaaacaaaaaattaaccaatatctggaatcaaacattttatattatggccaggctttggtccctgattgattgattgatttttcttaaagatttatttatttgagataaaaaaaaaaa

SEQ ID NO: 1159 - DNA, 163 bp, dog
gttgtgccctcatcaccaccatccatccataggactcttttcatcctgcaaaactgaaactctatccattggacaattgtagctccttattcccacttccatcaacccctgacaacaccattgtactttctgtgtctatgaatttgcttcataaaaaaaaaaa

SEQ ID NO: 1160 - DNA, 262 bp, dog
tctctggggtcactgcttgcctagacttctgtgcccgtccccacagggacatccacaacatgaataatggaagcactgtggtttgtactttaacacgagaagataaccgctccttgggggttatccctcaagatgagcagctgcatgtgctaccactctacaaactctcagacacagatgagtttggctctagagaaggaatggaagccaagatcaagtctggggccattgaggtgctcacaccccgtcgtaaaaaaaaaaa

SEQ ID NO: 1161 - DNA, 242 bp, dog
tctctggtgcagggtagatttttaactccaaatttaattttttaatgactagaacagtttaggtaaacctaaaaccgtaaatctaaactgtttcctctttcttcttaaaagaattctaataaaaattatacctgtatgaatttctctctgtttttaaatgtgttggtataaagttgatcatagtatctgttctatctccagcatgtgtggttatgttttcattccttttttaaaaaaaaaaa

SEQ ID NO: 1162 - DNA, 192 bp, dog
tctctggcgagagggagcagttccccaggctgagtggccgtgacttaccatcttctcaaggctgtcgcttgctcagagtgtctatttgctatgctgaatgcagcccaaattactttttacgatttgtgatgccttaccgattggatcttaatcctgtatttaaagttttctaacattgccttaaaaaaaaaa

SEQ ID NO: 1163 - DNA, 153 bp, dog
tctctggagaaatattggaaaccaataaaggaagcctgcctacaaatagaaacaaagatgcatagaaaaagtaggttcttgaagagctcaaaaatatgtccccacactattctaagtctgtagttttcaaatttattagcataaaaaaaaaaa

SEQ ID NO: 1164 - DNA, 262 bp, dog
ttgatcctagggacagtaggagagtgagcatgatgagatggctttttaaagatgaatattgcttctgaaaggttttgaaaattttaacagggacggtgggtttcttaggggttggacgtctgccttcggtttggtgtgatcccagtccctcattgagtcccatatcaggctccctgcatggagccaccttctccctctgcctgtgtctctaactctctctgggtgtctcatgaataaatagataaaatcctaaaaaaaaaaa

SEQ ID NO: 1165 - DNA, 252 bp, dog
ttgatccaatatctcaatcaaatcaattctgtgggggcggggggagaaggtcaaatgaatattttgactgaattacataattgcttgactaggtaattggtcatcttagtgtaatgaataatctgaaccactgcacagaactagcttcttgtctagtactcaaactgttcttttatattacaattgggcgttttagttgtggctaatacttttgtaacaatgtgggtaacccaactgcatttaaaaaaaaaa

SEQ ID NO: 1166 - DNA, 226 bp, dog
ttgatcctataaatcaagtagtccacgtcatgcaactgggcaaatactgcaaatattcacctcattaacgtggaatcaggtgctgcaaattagttttggaatttaatggtacaacattaagaaaaatggaatgaaataacacaaattgtgaaatatatctctcatcaaagtctaacaatctcctgtattgtgaacagcatattataatattaggtaaaaaaaaaaa

SEQ ID NO: 1167 - DNA, 208 bp, dog
ttgatccagcaagcaacaactgttaaaaacaaggatatcagaaaatttttggatggtatctatgtttctgaaaaaggaacagttcagcaggctgatgaataagctctgagttgtccagcaacagaaacagcaagatgccagatgatttttcagacttatttgtgataccttaagaatgcaataaaaactacactgataaaaaaaaaaa

SEQ ID NO: 1168 - DNA, 168 bp, dog
ttgatccatgaattcagatagagaggcagggtgatccatttgtggaaagaaagtagagggacttgatgaatctgatggtagatgggatcagatccctttagtgtctttcccaatcccaggaaatcttagactttatggtaatatttacagtaggtgtaaaaaaaaaaa

SEQ ID NO: 1169 - DNA, 311 bp, dog
ctgctggtctaccaaacataagacgtagtacagacaataaatgctagtgaatatttactttaattgtaagagttctctagcaacctctagcagtgtaatatatgcctagcttaaatgtaacataaaaatatttcctattatctttgtaataaatataaacctattaaaacctgtctgaggggtacctggctcagttggtggagcatggggacttctggtcttgggactatgattttgagccccacgttgggtggagataaaatctttttgttgttgttgtttttggagataaaatcttgtaaaaaaaaaaa

SEQ ID NO: 1170 - DNA, 183 bp, dog
ctgctgggctggagtgctttcttcagaaactagatttctagaaaacatctgctttgtgttctcacaattcaaagaacttgaagtatgtgaagtaagacatggatttaaaaaggtctggctaagaagcaagcaggaataataagggagttgaatgcagtaaggaaagattattaaaaaaaaaaa

SEQ ID NO: 1171 - DNA, 260 bp, dog
acgatgctaaaaccaagagaggtccagccacattgtgataattggtcatctaaacccagtctcccagttgtgtggtcccactgtgtgaccctggccgcttctcctcctcctctgttgcccagagagaatattctcagagggaatatctaactcatacatttgttttaaggataaaataaaacatgtaaagcattaggctcagtacatggcatatattaactacaaataaatgttagctatcattacctaaaaaaaaaaaa

SEQ ID NO: 1172 - DNA, 216 bp, dog
acgatgccatcagtggtaatgcgacactacactttaaataaatgttgataatgttttgtatatgttttgctatttttgtatttttctaacattctgaattatttaggtgctcccagaaaattaacatatccatgctattgctggagcccactttgtatttagccattatttctggtaactggttcacatttcccttttccatgttaaaaaaaaaaa

SEQ ID NO: 1173 - DNA, 128 bp, dog
acgatgcaccccagaaaacatatataacagctgaagacagcctcttctcttgatttgtgatatttatttatatccactcatagcagttcctagacatagtatacccatagtgatcctaaaaaaaaaaa

SEQ ID NO: 1174 - DNA, 185 bp, dog
acgatgcaggcggtgaaaagctctattcatcctcttaagaatggggtcttgcgtctcttgtttgtcctctctgtagagcaaggtacttatctaataaatacagaagcttgaatattcgtggttccaaaggtgaagagcagccatgttttattcctcaataaacaacaatttcctaaaaaaaaaaa

SEQ ID NO: 1175 - DNA, 146 bp, dog
cagcagcacatggaattccaaataagaatgtgtcttcatggggcacctgggtgactcatttggtcaaacacccaactcttgatctcagctcaagtcttgatctcagggtcgtgagttcaagccccatgttcacttaaaaaaaaaaa

SEQ ID NO: 1176 - DNA, 276 bp, dog
cagcagcagtacagtatagacatcaaggccactcttaaagatggctcacttccctaagtaatttttaaataagcattgagaagtgaaatttgaaacatctgggtggttcagtcagttaagtgtctgccttcagctcaagtcgtgatcccagggtcctgggattgaactccatgtatcaggctacctgcttagtagggaatctgcttctccctttgctcctcgtctcgctgtgccctctctctctcaaataaataaataaaatcttaaaaaaaaaaa

SEQ ID NO: 1177 - DNA, 193 bp, dog
cgacgctacggccacaagattggccccctttccccattcacaagtgcctaccgcaggaatgggatggcttttctggcctgctgatgggactgtgactgtaacaacaggaaaggcaatgttatattaaggtgatttctgttcccctctttggacaaaataaaatacaagtttaccttctctgtaaaaaaaaaaa

SEQ ID NO: 1178 - DNA, 371 bp, dog
cgacgctgcagtgcatatgttctcgaggtacagtcactagcactcctggtgcctaccaatcacgtgatcagtgctttagacacttgcacttctcatttgtcaggtgatccagaagggcttggattgcagacctgatttgagccaagactctgctgctgattctcttcaaaaacctggccaaagcccttggacctcactcattccgttctacttgtcatacacattattactcttctttaccaaaaaatccagattgcttagaaaaataaaatacaactcaagacagaatcagagttttctaagtgacgaacttttcaacatagtttgtacctcaacccaaaggtgttctttccctaaattaaaaaaaaaaa

SEQ ID NO: 1179 - DNA, 212 bp, dog
ccagtgcacttaccggagtataccacccaacttgctccacaaaagcctggacaccagatcaaccagagggctgcacatggatcatgttattttggttcttacataatgatagaaggatggtgaagtgaatttttgcattataaaatagttactggaaaaatgatcatgggttggggtgccaccacagtgtcacatttacataaaaaaaaaaa

SEQ ID NO: 1180 - DNA, 198 bp, dog
tcccagctacatccatctgttgcaaagagatccacgcactcatgtgactcacctggtgctaccgagggctgatcctatccaagaccctcaggacttgccctcaaagccttcctgggtgaaaaatagcaccagttgcttgctatttctctgccggtttctggttgccgtggtatatttgtgttagtgtaaaaaaaaaaa

SEQ ID NO: 1181 - DNA, 171 bp, dog
tcccagccctgggctctttccttagtatttgttttataaaaattgttgcctttgtaatggactgtcacttggaccacccccatccccccacccctgccggcaggggctggaaacgtgtcatttgtaaaagaaggaaaacattgcatttgttcacttttgtaaaaaaaaaaa

SEQ ID NO: 1182 - DNA, 411 bp, dog
acggggtttgcaaaatgatgtttcctaattctgaaagactttcaacacatattttgctgctgttcttatattgtagaactagaaagaactagggctgtttggttactcttaaaaggtgggataactacatgattttttgttttaattaccagtttttgaagtcagaagctgttgtagtagttatcagaagaattgatagtgggttgcctgggggacttagcagttgggtgccttcctgcagctcgggtcgggtcgttatcccaagatccaggatcgagttccgcattaggctcccttttgaagagcctgcttctccctctgcctgtgtctctgcccctctctctgtgtctctcatgaataaataaatcttaaaaaaaaaaataaaaaaaaaataaaatctaaaaaaaaaaa

SEQ ID NO: 1183 - DNA, 697 bp, dog
accaggtacaatttagggcaaagagacctagtttttggaattaaaaatgtgccgagttaagtcatatcctgtttacacaagtttaaatatactggcacaagttgttaaaactttcctgaaatagggagcatggtaaattttttgagaccataagagtggtcagaaaatgttttcattctttgtcattttattaatggatcctagtatattgaattccaggttgaaatttgtttcttcttataagttgaaaggtctttctataataaattttatattatggtgctcttgaaaattccacagtctttctaattcctgatactttgaagacttttatttatttaagggagaaggagagagagtacaagcatatggaggaacagagagagagaatctcaagcaggctcttcactgagcatggagcctgagcaaagcttgatcctatgaccctgagatcatgaactaagccaaaatcaatcaataattggacactcagctgattgagccacagaggtgtcccacctgatactttgcttatgacaatttgtattttttatgctctttggaagcttgtaaaatcttccctttgacctcagttttctgaaaagttggaggagctcttgaagaaaaaggataccaaggtacaaaatagaatgaacctaggtacaaaacacaattgtctaaaatggaaaaaaaaaaa

SEQ ID NO: 1184 - DNA, 176 bp, dog
accaggtccagatgaagggtccctccttttatatcttccttaatcccacccttatttttctttgccctccagccataagcaaactttctcaactttaaaaatacagtatgggaggtctacagcaggttcaggcaataatccagggcagtcataaaatttaaggcgaaaaaaaaaaa

SEQ ID NO: 1185 - DNA, 332 bp, dog
tctctggcctgaatttaaatcctaacttcactattttatgtttttggacaaactgcttaaacatgctgaattgttctgcttttctaaaaaaaaaaaaaaggtgagcttttttatagataataagataatagaatttgtctcatagagttctgaggattgaatgagatgcaaaataaggtatacactgtaatatattcctaatacatcccggttatatgtttttcaagttcaaagaaaatgggtaatgctcacttttagaaacagcagattagaactttttaaaagtgcttattctcattgtcatttaaattatgttatttgaaaaaaaaaaa

SEQ ID NO: 1186 - DNA, 496 bp, dog
ttgatccccttcacccatttcatcaaactccaacccccgagctctggcaacaccagtatgttttctattgagtttggtttttggggtgttttttgtttttaaattccatacgagtgacatcatacagtatttgtctttctaggtctgattcacttcacttagcgtatggccttcaatgtccacccatgttgcaaatggcaagatttctttctttttcacaattgagcaatattccatcgtgtatacattccacatcatctttacccattcatccgtcagtacacttagattgcttctatgtattgcctattgtaaataatgctgcagtagatgtgagatatatgtacctttttaagttagtctttttcattcctttggataaatatcaattagtagaattgctggataatatggtagttctatttttttttcatcaaaactccatactgttttccataatggctacaccaatttatactcccacgaaaaaaaaaaa

SEQ ID NO: 1187 - DNA, 325 bp, dog
ttgatcctatgctaagtaggacttttgaatcaacctacacaacaccagaatttgtaaacatagaccatcgtaaagaaaggaacaagtagcatcttatatgctgtaaaatattttttttattctgaattgcttacttgttaacggtcatgttaagattagtatagacagaatagaataataatagcctttggagtccagttgtctagatatgccccctggatttacctccttctagttgtaaagttgggaaagttatcaactctgcctcctttcttacaatggggaagtgatatctaacttacaggatatttgtgaaaaaaaaaaa

SEQ ID NO: 1188 - DNA, 287 bp, dog
cactagctacacaagactgttaaaataatgtgttggatctgtatgtgttaaccgtaaaacattgatgaaagatactggagaaaacctagaggttagtgttcatggataggaagactctacatagtaaagatgtcagttctccccaaattgatattgacttaatgcaattccaaacagaatcccagcagtattttaaaaaaataaatatagacaagttgattctaaaatttatagggaaaggttaaagacctagaatggaatacctaaagcacttcgaaaaaaaaaaa

SEQ ID NO: 1189 - DNA, 114 bp, dog
cactagcaatatgattgattattctctgattagattctttgagtgccagatgcatccttatctagggtatgaggtattgatatggcagcatgttatgaacgggaaaaaaaaaaa

SEQ ID NO: 1190 - DNA, 629 bp, dog
tcctggaggcaaccactgttggtagttcttagcttttcggatttatgttatgaatatacggatatatttctttctcttttttcattcttgcacaaagagtagtttattctatccactactctgcatatatcttaagaattgtctcagcggttttggtggctgcattcaattgaaaggatgtagcatttttcatctagtcttctgttaatggacatttaggttgtttctcatcttgtaccatcacaagccaacacagcaatctaaaactttgtgcatgtgccatttttgtgtatgtcaatatataaaggatatgtgtatttatcatatcaatagatgtttcccattaccctccatggagattgtactaaataacattcccaccacaagtgtgcttctttcctcactctagacaatgcaatgtatgatcacatttttattttcgacagtctgacaggttttaaaaaaatggtatctccttgtagttttgcatttttctaattatgagggaggttgaacatcacttcatgtgtttaagagcaacatttactttcaagattcattacataaaaaggagtcaatatttccttctaaatttgattagattttcccccctcagtgaaaaaaaaaaa

SEQ ID NO: 1191 - DNA, 501 bp, dog
ctgctggtccctcaattctcatgtctttgttaaaatccttctcatcctgcaagacccgattcacttgccattgtgtatttgaattaactaacctcatgtcagaaaaaaaaatcacctcttttgaatactcctagtttatttgtatattcacttagcacttatttcattctcctttcatactatctcaaaagacaacatgaggaattttagggagcatgctaacaacattagaaagacacaggctacaattgcagctttaccccgtcctcactacatgacctggggcaacacacttggttcaaactcttagtctgttttcatcatctctaaaatatggataacagtagctactctatacaattattatgaggtttagaaaaatctatatgcttataaacatctgctatgatttaaataataagtgtcacaaagaaatatttcctctagatggttttcgctaagcaaactcctctgatatttatccctctggaaaaaaaaaaa

SEQ ID NO: 1192 - DNA, 414 bp, dog
ctgctgggtggccatatgatctaggtgctgtggacaaaagcactttccttaataccagatcatctaagagtctaacaggaggttaaacataggactgtagaaatgagcagtgcaggtgaaaagccctcaagttcaaatcatgatcagggactttttatccaccttcattttggtaattgctatgaataaaaattcaggtttttataattgcatgtgaaatagcatattgatttaggtttttcggaaaagaaactaaaattagtgttcagtacacttcattgctcagttctctgaaggaaagatttcttctattttctttatatggaaaaccatttttattacattttgttttacctaagtaaggtttctatttctgtttcagaacaatacttaaaacaacgggaaaaaaaaaaa

SEQ ID NO: 1193 - DNA, 213 bp, dog
ctgctgggtcctgcttgggtttaatagaaatgaagcctccaaagcaggcgggctgttttgggaaagtggccactaatgcggccccatggggcaggggccaggcctgaactgggcagtttgcatattcacttttacaaacagttggctcagagtcagcagttaatgggatgggaatgatgttcctgtaccaaatcatttcctgaaaaaaaaaaa

SEQ ID NO: 1194 - DNA, 165 bp, dog
ctgctggcctagggatgggggtggggacccattgctggaagatggcaccatcgtggctaccctcactgcaacaaacagggagcttggcacccggctccaagaggtagctgccctagaggggctcagaaaggacaaaataaagtgtgtgtggtggaaaaaaaaaaa

SEQ ID NO: 1195 - DNA, 239 bp, dog
gacctttagcatttttaagagaaataattaacctggagagtaagaagtagaatatttcagctcaatgatgatttttttcatacaaaagatataaccaaaaaaaaaaaaaaaaccctggtcatatcattttatactgtcacatctaagtgacatggcaaaaattatctgaaatcatttctcaaaaagttgagtataaatctatggaaggctagccatatttcatccaggaaaaaaaaaaa

SEQ ID NO: 1196 - DNA, 535 bp, dog
caagtttcaggtccccacttgacaagcaaggtgtaggatttctttttatcatggtgggaaatctttcccataagcccacaagagacaccatctcagaagccattgatccagaactgggtcacagcacacccgaatctgtcactgcagaggggaacagaattcacagtgccattcctggtgtgccatagctcttacctgaacagaatccagatcttcctggtagcaaagtggaaggaggaatacctgtgggctaggcatccatcgtgtctaccaaaatgtctaccttagagtaaaaaataagttttagaaggtgatgacacattttgtacccatccaaactaaaacaaagccagggttctttgtggcagcagatcattttaggggcattctcaaagacccatccatattagtgcctttgcccaagtctcgtgtacatagtgtgagagctttttacaagaggaaaggatgggatcactgaagtctcagtgactgctacttccaatctcagcaaaacaccccaaaggaaaaaaaaaaa

SEQ ID NO: 1197 - DNA, 296 bp, dog
gttatagttagttggctgttgggttgtaatggcaggaacagtttctctctttttatccctttctttctgccaacagcataacacttaaatgtataatttttatacttctgtagcagtagctctagtatcatgggttttgtgtgtgtgctattctagttgttgcctaaaggttgtgaataagcatttataccaggaatgcctggggagctcaatcagttaaggatccaattattgatctctgctcaggtcttaatctcagggttgtgagttcaagcaccacattagaaaaaaaaaaa

SEQ ID NO: 1198 - DNA, 175 bp, dog
gttatagtaatacaaataaaggtaagtgtaacttgcatgaaataaaagaaatctgaactatgaagttagaggagaacaactttcaaggtagctgggactctgcaatgggtatttgaggtagtatctgaatgtttaggtttaaatgttggtcaagaggttgattgaaaaaaaaaaa

SEQ ID NO: 1199 - DNA, 203 bp, dog
gttatagtgaaataatgataaagaagtattctggaccttttctaaaatctgggatttgcctgggatgtatcacctgctcttttttgatttatctggatattacttttcaagggttaacctaaatcctatcttttccacagttaatttcctgttttcgctagtttatatttattttctctcttaattcttctgaaaaaaaaaaa

SEQ ID NO: 1200 - DNA, 198 bp, dog
gttatagttgatgggtttttttttttaagcagtacaaaatagcttgtagaatttttccccctttcttagaggcacataaaatatttgtgtccttttcagtgtttttactcttaatatttgattttactcagtgctgtatatttttaaaatgcacatcacccagaatgctgtttagaaatgggattagaaaaaaaaaaa

SEQ ID NO: 1201 - DNA, 259 bp, dog
aataacgggcactcagcatgtgtaagaatttaagggagaaggaaagagtttagaagtaatcaaagaaaataaaattgattgtagctgaaggagtcttcagattgaaagtatctactgagcgctgagcccaaagaaaggaaaactgggcccctgactggctgagtcagtggagtttgtgacttttgatctcaggattgtgagtttgagctgcacattgggtatagagattacataaaaatgaagtctgggaaaaaaaaaa

SEQ ID NO: 1202 - DNA, 176 bp, dog
aataacgaagagcaaataaaaccaaaccaagcagaagagggataataaagactcaagcagaactcaatgaaatagagaccagaactgtagaacagatcaacaaaaccaggagttggttctttggcagaattaataagatagataaaccactagccagccttagtgaaaaaaaaaaa

SEQ ID NO: 1203 - DNA, 346 bp, dog
aataacgtgatagttctaggaaaagagctgcaatggtaaattaaattcactgtcaatagatgaaaatgaaatagcttttctgcattaaacatgaggtggtatcagatgtgcagggatgttacagaaaattggtgtttatcaaggatattccaaatagtaaattaaatgccttttcatttgaatatagtttattttcagtgggttggaaagggtgcaccgagaattagatcttttgtttttagtccacttagttatgcatttttttttattacattgaaattgcttatttatagttctgaggcatgttattcatatagaacaagaatatccgttggaaaaaaaaaaa

SEQ ID NO: 1204 - DNA, 160 bp, dog
aataacgaagaggaaattagatctaaagcattcagaagaagaaaattataagactgataaatgaaatggaaaacaaaataaatgaaaccaagagttggttctttgaaaagatcaatttaattggaatatgtttaaccatactgatcaagaaaaaaaaaaa

SEQ ID NO: 1205 - DNA, 350 bp, dog
tcaaagaatatgtaaataacagaatttttatttttttcattgtatgtttataaatgatgaataatcatatatcaaagatagaaccataatgacaaaactatattgtgtattcttctcactggtaatttatgtattttcttaaaattagccatgctagctggagctacagcagtttactctcaattcattactcagctaacggatgaaaaccagtcatgttgccctgtctgtcagagggtttttcaaacagaagctgaattacaggaagtcatcagtgatttgcagtctaagctgcggcttgctccagataaactcaagtcaacagaatcagaactaaagaaaaaaaaaaa

SEQ ID NO: 1206 - DNA, 189 bp, dog
tcaaagactaatgggattctgtaaaaaaaaaaaaaaaaaaaaagaagaagattgggacatcttaaagggtttcctactggccaaagctgggacaatttgagcatccaaaaaataattactgtatctaaataaaacacaataaatttataaaaatctgtaaatccataaattcactcagaaaaaaaaaaa

SEQ ID NO: 1207 - DNA, 474 bp, dog
tcaaagaccaacctccagattttcttcctaactcattgacctctccttctcagtcttcttgcagactctcgattctcaatccatcctttggatgttcaatcacaggtcgaggctttcctcttgctatacaccttccatgagcaatctcgtctatttccaggtcttcaattattctctcttcccctcctgacaaacatatattaatctacctgatgcaaataaagcatcagctctgttcactcttagagctaaaaccttgggggatccctgggtggctcagtggtttggcacctgcctttggcccagggcacgatcctggagtcccgggatcgagtcccgggatcgagtcccgtgtctggctcccggcatggagcctgcttctccctctgcttgtatgtctctgcctctgtctccctatcatgaataaataaataaatctttaaaaaatatattaaaaccctggaaaaaaaaaaa

SEQ ID NO: 1208 - DNA, 392 bp, dog
tcaaagagatgatgtgaagaaattttaaaaagctgtttcatacttgaaattataagatactttaaacttcacccattgatttgttagtagatgctgggagactgggggagggtatcttttgtgtgaaacctctaaatggaatgctatactgtattccctgaaaaatccacctgtaaaaatgcattattctaattctgtatttctttctgcttttttctaagctagaaatttttgtcactcagttactacatattaaaatgggttacctatctcagaccttttcatgtttgccaaaagagaaaagtaaatggacagtagttgttattaaaatgatcttctaaattggtttattccgcaagatcttccaagccactaccatggaaaaaaaaaaa

SEQ ID NO: 1209 - DNA, 315 bp, dog
tcaaagacagtttggtgatttgttataaaactaaacatactcttaccatagaatccagtgattgcactttgtggtatttacccacatgaggtaaaaacttaagtctgtacaaaacctgcacacagatgcttatagcagctttattcataattgccataacttggaagcaaccaagatgttcttcagtaggtgaatggaagaatgatatggatgcagataatggattgatgttcattgctaaaaggaaatgacctgtcaagccagaaaaaaacatggaggaatcttaaatgcgtattactgagtgaaaaaaaaaaa

SEQ ID NO: 1210 - DNA, 242 bp, dog
tcaaagaccaagtacaaaaaaataacaaaatatcttcttaagtattaaaatgaaactttcagattaaataaattaccaaaattaactatttcttttttacttttaaaatgcaaattgtagaaaatttaagattatatatatggcttgcatttatttctgttgagcaacatttatttagaagtagagttagaaaaagtaactagattgatggataccgagataaaagaatggaaaaaaaaaaa

SEQ ID NO: 1211 - DNA, 230 bp, dog
tcaaagacacatcagactagaaggacttaatagatatatcgagaacattccatccaaaacagcagagtacacattcctttcaaatgcacatggaatgttctccaggatagatcacatattaggccacaaaacaagtcttaataaattcagaaaaacctgaaatcttattaagcgtattttccaactacaagggaacgaaactagaaatcaattaccaggaaaaaaaaaaa

SEQ ID NO: 1212 - DNA, 221 bp, dog
tcaaagagcaatttatatgaagaaaagcaaggcattaacacaaaaagttgatgcttttatctaaaccccaatttaactgcaaagttggaccatgtgagtgtcatgagtaatattacataaattccaaatttgtaatcaaatttctgtgatgggatgtaatttgataaagaaatcatacttgcagagaaattattccagggattatttgtgaaaaaaaaaaa

SEQ ID NO: 1213 - DNA, 182 bp, dog
tcaaagaggagaatggtgctggcctctacttcaagttaaatgataggaccttgaatagacacaattaggaactttacatgtgacactgaaaatttaggagatataggggctggcagctatctcactcatgagagtcaagtcaaaaagctggctggaggggcctactgtaagaaaaaaaaaaa

SEQ ID NO: 1214 - DNA, 160 bp, dog
tcaaagaacactggagttagaaggacacagttgccaacctgaaagggcttccactagccaaagacatgaaaatttgaacaacaaaataacaatgactgcaattagttgaaataaaatacataaaaatccatgatttcatagttatactgaaaaaaaaaaa

SEQ ID NO: 1215 - DNA, 342 bp, dog
tcaaagaggaagagggtaattcacaggatgttaagaagaacagatgggaggcaggtagatgtttgccatgtcatacagttagttgagtcattcagattaaaaattccctctggtaatggcgccccttctgagccaggccccatatctgaattattttaggtggttaagggagggaaaatgtttttcttgaacctgagaggtcttgatcattttcagctcaaaatccccacatgctacagtagcacattttgggggtcatgtattctgctccctctcagttaccagtgtcatcctgtgatgttatatgaaaataaagtttacatttgattggaaaaaaaaaaa

SEQ ID NO: 1216 - DNA, 257 bp, dog
tcaaagacaaaggtaagtggaggttatgactgtgtccctgtttgataaggaaatccacagagaaagtttaatgttatttattaatcctggaatagtatcaatgccagaccttaggtgcttacatgcagaaccctctaattctgattaaataataatagttactatgtattaagagttaactatgtgcttaacggcaagataagatctttgcaaacaatagttcagttaatcctaacaccaactttggaaaaaaaaaa

SEQ ID NO: 1217 - DNA, 183 bp, dog
cagcagccaggagacaatgactcatttctgaataagcaaggataattttcacacctgtctttgaaaaacgttgctccaggagtctagagttccagcaagaaatctatctaattctgaaagtccttcaaaggacagggtcatacttgcaggctgaggggtgttagttccattgaaaaaaaaaaa

SEQ ID NO: 1218 - DNA, 387 bp, dog
cagggcacacccacataataaaaaacttaacagaactggaaaatccagcaaggaagaggaaaaaaaagaaatgaagagtgagtgaaagggagcaggaagaagaaacaaagggcaaaggagaagaaaaacaggaaaaagagtatttacacaaatgagaaacatatttatcttgtcgcagacgctgccactgatatttgcgtagaattccaagagttttgactccaaggaaaattatgctgaagtgaatctcaacaaagcttgatgacagatagtagctgtgcttgtggtgagcacagtgtaacatatagagttgtcaaatcacaatatcgaggacctgaaaccagtgtgacattgtgggccaactatacttcaattgaaaaaaaaaaa

SEQ ID NO: 1219 - DNA, 413 bp, dog
cgacgctgaataaatgtgtctttttttaaatgtgctgtgtaaagttagtctactctgaagccatcttggtaaactaccccaacagtgtgaagttagaattccttcagggtgatgccaggttccactcgaaatttatttgcaacctgcttgggcacagaagccattgtctccacaaaccttggtgtggttgaactgacagttaatgtgttgtgacctggagttcaccgttaaaagggtcacccaagcaaagtcctggagtttatttggttattatgattgttggcacatcctatgcaatatatctaaattgaattatggtatcagataaaattatagatgggattaaagcttgtgtatcgtccattatcatgtgtaatcaataaacgatttaatattctcttgaaaaaaaaaaa

SEQ ID NO: 1220 - DNA, 278 bp, dog
cgacgctgctagctgtactgcagggctttgtgtaaaaggtgtgctttcaaaccaaagacatgactttgccccagtagcgtacagtgaaagttcatctctttgccaaatttgctaagcatgagaaaagtcgttgagcccagaacaaaagtggtaacacaggcacaatctagtcatttgttatgagcggtaggaacgtgtgccaaggtggcaaaaataatacaccatcctcaaagagagtcttagaaagaatcacggagagaaccctggaaaaaaaaaaa

SEQ ID NO: 1221 - DNA, 154 bp, dog
cgacgctgcgatcccaccaattaggaatgcatccagaggaaataaacctgttgatttatttaaagatttaatcataagaatgttcttagcaatgttcattgtccaaatatcaattgggtgtttactctctgccaggcatgaagaaaaaaaaaaa

SEQ ID NO: 1222 - DNA, 166 bp, dog
caagacctagctgagtgttgtgttgaggaaacgcggggcaagggcaggccggatggtggtccggagccatcagggaggcattccgggaagcacgttttgaggcaaaggtgatgagagcatcattttgttaatccaagaaaatgaaacggttggagaaaaaaaaaaa

SEQ ID NO: 1223 - DNA, 317 bp, dog
gcctttagtaggaaaaactgtaaggtaaatacttgagaaatatatgcagaagaactctgtttggtttccaaaagaaaattaataacacgacatgtgattttaatatctcctatacaacagtcttaaaaaactgtttcttcttggttcactttttgcctaacactgtcagtatgatttaatttttatacagtttattgatcatatggtctggattacagggcactaatatattaaaaaagagaaacatagttttctgtttattctctcacagaaatatataccaagcttcatctcccttgtatctggaaaaaaaaaaa

SEQ ID NO: 1224 - DNA, 249 bp, dog
gcctttaccatgtatcatatttccataggctcttaggtctatttctggatttcctgtcctgttctattggtctgtcttgtctctttatttgacagtaccattcctttctgtattgaagctttgtgtgtttcctgctatggccagctgcccctcctcccagtcttccttgtcatggttttcctggccacttacgttcacttttccagtgaactttctcatcagttgttttaggctccagaaaaaaaaaaa

SEQ ID NO: 1225 - DNA, 222 bp, dog
gcctttatggtgctgactagtgccaggcagccttttacaaagattggccaggctttcattgtctcagctgtgcatgcccgaataacccactgaccctcccagattaaacacatacacagaagacagatttttaaaggctgggggtacagtaaagaacatgctgcctctaacttcatggaaagacagggtataagctgataaaaatatgaggaaaaaaaaaaa

SEQ ID NO: 1226 - DNA, 190 bp, dog
gcctttaggtaacattatctttgggcctttcgagaagggaaagaaatgagtccttcctcctcatgcttccagaaagtagttatgctgaagttaataggaggcttgccaaactcattggtgtgatcatttcctccactaccattgctgcggctttcaatttcaaaatagtcagtgagtagaaaaaaaaaaa

SEQ ID NO: 1227 - DNA, 466 bp, dog
tatttatgcacttcaaacacaccaagctcattcattcatcaggacttttgaatatgctgattcctgtgcttgggatacatttcaaccttgcatcttttcaagctacctctttattcaagtttcaaacctaaagtcatttccttagtatgactgatttatctttctgacttccattcccggtcactccctggtcacttttcattacataaatggtcactttttgaaaataagatttataatctgattacctattttttattagtctcctctcatcagaacataaaatatatgaggacagaaaattttttacctcctattattattattattatttactatttatccagcaataggaattacgtccaatacatagtagatgttcattaagtatctgctaaacatatgaattaaagaatgggtaagtcactttatactcagactcagttgtctcatagaaaaaaaaaaa

SEQ ID NO: 1228 - DNA, 361 bp, dog
tatttatggtactggcataaaaatagatagatcagtggaacagaatagagagcccagagataaatccatgcttatatagtccattagcctatgaccaccgaggcaagaatatacagtggggaaaagaccatctcttcaatagatgacgttgggatagaccaattttacacgaaaaacaaatataaactgtaaatgaattaaggatctaaatgtgaactctgaccccataaaactcctagaagaaaacataggcagtaatttctttgacatttgtggtagaaacattttcctagatatgtttccttaggcaagagaaataagcacaaataaaatcttgagactgtacttggaaaaaaaaaaa

SEQ ID NO: 1229 - DNA, 263 bp, dog
catcatttaggatgaatctagctacctaagagatagggtaaataataataaataattataattcaacctcagatatttagccaataagaaatactttatgtgtgaagtaaattgagtggctccaacacacttctacttgtttctttcctctttaatttattttattttcccttcattttgtgttgttacaaacatctctgaatcaaaggacacaaaaataaatagcaactgtgttctcaatgagcccaatgtgaaaaaaaaaa

SEQ ID NO: 1230 - DNA, 573 bp, dog
ccagtgcaccaactgtatgtcaatcatttaatcttcacaactatgggaggcaggtgaaagaatatgtgcaagcacaagctgttgtccacaacattttaaagcaaatacagtctgtgagagccaatgattgctattaccagttctttagttaaagaaagatgaccccaatatcaatctaaaactctctaccctagtaatgaaaattcagatatatgcatattgggcattataaactagcaaggttgtttctcataattaaccagaaaggcttagaaattgatggttacatccatgggccataagactaaacttccggagtggagaggtattcaagataatatttacaaataatatttggaaacatatttacaattacagaaaaagaacaggaagattattaagatgtaaacatggcaacttgatctttttttcttaatatagattatgatttctataatttatatttcccttcctctcctgttttatcattgaattttctaaattgctacattactgaaaattcagattcagacagcacctaaataaatcaaatgtcatcgtgaaaaaaaaaaa

SEQ ID NO: 1231 - DNA, 288 bp, dog
ccagtgccaaatatctctgtaggcacgattataggccagggttgttgtaaatattaaatgatttaaaaaataattgttactttgaaattttgaaaaatgataaaaatagtacacattcaataggaaactctcagctctatagaagtgtaggcacagtctagcagatcactgtttctttgggcattatagattttaggccagtgcccacagatgggtggcacagagcccagagtgtttttgtttggctggcacaatgttttaaaaactgtagatttggaaaaaaaaaaa

SEQ ID NO: 1232 - DNA, 253 bp, dog
ttgaggtatatggacaatgcactctcgtgccaatttatatagaaggatacaattcttttttacgtgattgacgaaatgttacgtttttcattaggaaacactaaatcgtgtaatatttctgtttgtgctcctttcaattcctgacggcaaatcaagataaactattgctttgtctctttgagcagcctgaaagcgggatgaaataagagggatgcattcatttaaacatgctttgctgtacgaaaaaaaaaaa

SEQ ID NO: 1233 - DNA, 291 bp, dog
acggggtcagaaaacaaaaagtttctctatgctgattttttatagaataaatgatggatttagttgtgcatgtcaaaatttagtgtgaatgataaccagatatttttgttatttaaaaaacagcatagtggatctttccctgagaattgcttaggtattcaccatatgatctgaaaggcaaaaacaaaaacaaaaacaaaaaaacaaaaaaatgaaaggcagagaactttgttactttcaccagctgcgctcaaaatatttcttaaaaagtatatgtatgaaaaaaaaaaa

SEQ ID NO: 1234 - DNA, 288 bp, dog
gcaagttaaaagaggcgctattaatatttatgtcaggataacaggttaaagagggactgtctgaggtaaactgagttgtagggttatcgcaactgcataataacattagtatgtcctttcatttaataaatatgtaagacacaatactaaaattgaatgttgtagaaagaacttggatatggtccctatttatgagtcaggggacagtcatggaaacagtaaaatgttaaggttatcattgacaaatgtatggataggatactttggactgcaagtggaaaaaaaaaa

SEQ ID NO: 1235 - DNA, 327 bp, dog
tgcaccgtcacagaaatagtatttcaggatagttgcgggtaatgaatattgataaaaatggcatatattctatctttccttaacaaaaagggtcaaaataatttcattatgcacaaaaatgcattcatctgtagcaaatatttatatgaagggaaagatacaaacttcacttttctttattcgtgtttttaaaatagtctttaaagtatttatttcatccctaaaaacatgcaaaattttccttatcttttagttttttattgcagtcactatttatttggacttgtaatgagtctaatttaaaagatacagaactaaaaaaaaaaa

SEQ ID NO: 1236 - DNA, 178 bp, dog
tgcaccgataactccatagggtcactcctgcagttgcttgactccttcaaggaaggaactgtgttgtatccccctttgtatgccaagtgactaccacagtgattgccattcaataaacatttgaaaaatgttcattaagtgaatgaatggattcttattcagattctaaaaaaaaaaa

SEQ ID NO: 1237 - DNA, 329 bp, dog
ctccggagacaggaaatggccattcagcaatcactggggatgcgctgcccagaagacgagtacgcaggctacggttaccatagctaccaccaaggataccaggatggttaccaggatgactaccgtcatcatgagagttaccaccatggatacccttactgaacagaaatacgtaaccttagccccagccagtttcccctgcagctgttaaagccacaagtggccagctacgtaaagaagtttttccacactgcctacattccttgcctttttctttccgtgttcttccaaaattaaataaatagcaaacttttgtctaaaaaaaaaaa

SEQ ID NO: 1238 - DNA, 153 bp, dog
ctccggaccagagttctctttatttattaaagatgttttctggcaaaggccttcctgcgtttatgaattctctctcaagaagcaagggaacacctgcaggaagtgaatcaagatgcagaacacaagaataatcacctgctttaaaaaaaaaaa

SEQ ID NO: 1239 - DNA, 216 bp, dog
ggctgacaataattgaggtggagaaaattccaaatgaaccaacagaggagtgacttaagagggcagaggagatctcgtgtagttaatttagaagtaccatgggaaataaatcaggagacgtgaagagtaaccagctcttggtgggaggtgtatatcactgagcaatgtacaagctactgtttactcactgcaatcagctggtggctaaaaaaaaaa

SEQ ID NO: 1240 - DNA, 390 bp, dog
cggtcctatttggattggtcactgggacagagaatcatttcactcccaggagctgcacattcaactcccaagaaccccataatatactgcccctggcgtcgagtcagatcaggtttggacttcttccactgagcatgacaagtacccgaaaggccaaatcaaccagcagaagtatggaaacaaaagcccaggttgtccccccggcactctcccgagcaggtgacccaacgcatcctggctccttgttcagacagctggtcagtgaggaagaagacgcatctacgccttcattattcaagctaggttggctctctagtatgactaaataacatgggaacatatccgtctctctctaaataaatactacatcatttcttctaaaaaaaaaaa

SEQ ID NO: 1241 - DNA, 128 bp, dog
ttattcggtcagtagacttggtgtgtgtgtggtgtgtagaccagggtgggtggtgctggtcttctgggggagtggcccactgctagctctggctctcaggcatgcttgctctagtttaaaaaaaaaaa

SEQ ID NO: 1242 - DNA, 138 bp, dog
tgaattcacagcagttatagccttgaagttattttgttagtttttttacattcacccactgggggatggacttttttgataggaatgtgtttcttcttttctgtaggaataaaaacataaaaatgctaaaaaaaaaaa

SEQ ID NO: 1243 - DNA, 256 bp, dog
agaggcagctccccaacccccgaggacactaggatgcttcagggcagtatcaaataatagtgtttggcataattaaatatatagtgagtggacctcagaaagagtaggcctatttgaaatccaaacttgttcttgaaagaaaggaaggttcacttcactaacccattcacccttggagggcaccaggttacccagagctggatcaataaggggtccattcaatgtgtcactttgtccttttctttaaaaaaaaaaa

SEQ ID NO: 1244 - DNA, 349 bp, dog
agaggaggggaagaggtggctctccttggacttcatcccaaagcaacccccacctttttaacactcccattcctgtcctggggaactaaccagtgtcctgcttgctgccctccaaggatctgtgggctgctcagttgtcactggcctccttacttaatccaatgcctacagatggcattccagttctaatcctcaccagagaagagagcagggtggtcactgtcatcttctcttgtggtcactgtcatctccctgacgcctctcctactttagcacatttcttcttttaactgggaagagaggcccttctgatctttctgaatggttcagcccttattaaaaaaaaaaa

SEQ ID NO: 1245 - DNA, 319 bp, dog
accaggttaactttaaagggaaactgatcatgagatttgatgacacaaatcctgaaaaagaaaaggaagattttgagaaggttatcttggaagatgttgcaatgttgcatatcaaaccagatcaatttacttacacctcggatcattttgaaactataatgaaatatgcagagaagctaattcaggaaggaaaggcttatgtggatgatactcctgctgagcagatgaaagcagaacgtgaacagaggatagaatccaagcatagaaaaaactctgttgagaagaatctgcagatgtgggaagaaatgaaaaaaaaaaa

SEQ ID NO: 1246 - DNA, 163 bp, dog
ctctaagatctatcccattctcctctcccattgcatgtggcatctgctatgtgcatcactcccttcgggcagaagcagccttccctggagctaagaaatattcaaccaattgtgtttgaaatactcatattagttctaaaactatgcagtggaaaaaaaaaaa

SEQ ID NO: 1247 - DNA, 352 bp, dog
cgaaatggggcttgatctcaggaccccaggatcatgacctgagctgaaggcagacacttaactgactgagccacccatgttgccacatggaatactttacttactttttaaaggtcttctgtgactggttattgtccatattggctgttgattcaattagcggagatttcttttcccgtttttcactatgcagctttataaaagttatgcaaatgaaaataagaatactattaaaacagtattcatgagtaaaacacagaatttgagataacaacaaagtagttttccaaacatgaaacaaaaccaaaacaaaacaaataaaagatttaagttttacctggaaaaaaaaaaa

SEQ ID NO: 1248 - DNA, 348 bp, dog
gacctttatgtagccaaactgaaagattaaagcaaagaagaaaacgcagagacttcagaggctgcacactacaggttaatacacttcacagaacttgtcactaagcaaatttaaagtatgaccaatcaaataacaataactttccatcctgtagagaatgtgtgtccagagttgctgatagaaaaggacaactttcaataaaatgttaagagaaatgcaaataatacatatatgactcatacagggaaaaggcagtagaaactaactttgaagggattcatattataaacacgttcaaagaattaaggtgaggaaactttgcttaaagaattaaagtgaaaaaaaaaa

SEQ ID NO: 1249 - DNA, 903 bp, dog
tcaaagaccaccaattagatgaaaagatgatatcattagaaacagttaacatggaatatatgggatggaatgataattgggataatggaatgatattctcaaagtgctgaaggaaaataagtgctaatgagcaaaaatacttttcatgaatgaaagtaaaatgaaaatatttcagtcaaaaatttcaataacttcagttaagaattgatagaatttctcaccagcagacttgcagaagaggaatacaaacagtattcttcagacagaataaaataatcccagatgggagaagagatataggaaggaatgaaaaacaaaatggcaaataagttggtaaaccaaaagaatattgatctgatgaataataataacattttatggtttaattatatgaagattatactattactaaagtaataatatgtaaactaaggttgagggaaaaatgggagttagtgttgtatgacatttctacattttcttagaaggcttaaaagtatagacatataatattagactttgctaagttgaggatgaatgtcatgatttcaaggaaaattgctaaaaggaaagcaagtacataatgactacaatgctgatatgaggagaaatagaatcataaaaaattaattaacccagagtacattatgtaagttgactgtatgaagttaatgctatatataaaaatatgcaggggcacttgagtggctcagttggttaagtgtctttggctcaagtcatgattccagggtccttggatcaaatcctgcattgggcttcttgctcagtggggagtctgcttctccctcttcttctacctcctgctccccctgctctgtcaaataaataaaatctttaaaaataagtaaataaataaaaaataaaaatatggaaaaaaaaaaa

SEQ ID NO: 1250 - DNA, 267 bp, dog
caagaccgaagtacaggaaggtgaagatttaaaagaccagaagtaaaggtgaagaaaagacttagagaagataggaaaattggaagaaaaattacacgccttttagaagacaaaaataatttaaacctcgaaggcaggaagcagaagaaaaaaatatttagagaagaacaaggcaacaaggtctcagatacaaattgagaaagccagaaattggaaacgaggtggaaaataaggtcagggaaagtacatcaggtagaaaaaaaaaaa

SEQ ID NO: 1251 - DNA, 843 bp, dog
tatttatgcaagaatatagttggaagaaaagtgaaagtcaattgcattttttaaaatggaaacaagccaagtgtaatcaattatacttggacattttgtgaaagcaattctttctgttgtattaataataggtgtaccagaggaaaaggactgccagtcagggagatgtagaaagtacggtgaataagctgaagggaacgttatgagctgcacagtggctaagaagggagtgtgggtgttaactccccaataattttcaaagaagaggaggaaaggtggtggagtaaaggtcaattcagttagaacctattccaactctttgaggaacaagatagagttcgttttttatctttgtggttcgagatacagaagtgaagtccttttactctttttctcttcctatgatttttctctctttggattcctctcacatgtttttattaagcagggatcttctggcagcatgtctcattttccttgtttcttctgcccaactggcttctgtatttctttgaaactcttgtagtggaatctgatctgttttcactactgttggaggaaaactctctctaccattggttcaaatgattgggggcatgcagttaactggcaacagattaacaagagaaaagagaaaatgtattcatacacatatgagtgcacaaaagaattggctccttgaatagctagagataggaatttatatacccacttcataggggaaagggtgcagagaggcaaggcttctatagaaagaataaatgagcttaatgggagaatgataaatgggtttttagggaaacaaatggaaagtaataataatgtttgcttgaaaaaaaaaaa

SEQ ID NO: 1252 - DNA, 374 bp, dog
agttgctaaacaaatggggaccagtgcaaattctgatgagtagcattttatgaagacaaaatccaagccgcttttctatcccaacattacaccaggccaacatgaatggccacttaaggtagtttctaattctacttgtttctttcttgcagtctcagaataaaaacagaaaaaagaaaagaaaaaaagaagaaaagaaaagaaaagaaaagaaaagaaaagaaaagaaaagaaaagaaaggaaaagaaaagaaaggaaaggaaaagaaaaaaagaagaaaaagaaaaaaaaagaaaaagaaaaagaaaaagaaaaaaaagaaaagaaaagaaaagaaaagaaaagaaaaaagaaaagaaaagaaaaaaaaaaa

SEQ ID NO: 1253 - DNA, 420 bp, dog
agttgctgataacttagatcaagccacaagagtagcatatcaaaaagatagaagatggagagtggtgacattacaagggcaaatcataaaacagtcaggtacaatgactggtggtggaagcaaagtaatgaaaggaaggatgggttcatcagttgttgttgaaatctcagaagaagaggtaaatagaatggaatcacagttgcagagagactctcaaaaagcactgcaaatccaggaacagaaagtacaactggaagaagcagtagttaagttaaggcataatgaacgagaaatgaggaatacgttggaaaagtttactgcaagcatccagcgtttatcagagcaagaagaatatttgaacatccaagttaaggaacttgaagctaatgtacttgctacagcccctgacaaaaaaaaaaa

SEQ ID NO: 1254 - DNA, 377 bp, dog
ggctatgtgatggtatatggttttagagctggaaggagtaaagtcaatttagattctttagtcaatgtctccctatagtttctacccaaaatccaccttagagtcatacactgaaacattgtaatcacttattttaatcagatttttttcattgaatttacccttttaaatcaaacttccgtgtttcaaggcctttgtggaatcctcgcctgtctcctaatttaccagtcttgtttccttattcccttacatagatgctcttccccaagcatggaaatctttttgccatactcatttcccatttgttgattcctctttaagtgattgtatcctccattcctactatctctatttctcttcctctttaaaaaaaaaaa

SEQ ID NO: 1255 - DNA, 306 bp, dog
ggctatgtcaggtaggaagaccaactggtcccagtgtgctggaaacttttctgactttatcactgaatcactagtatcagggacaattcctcctgtttcaggcagattaggatgattggctactctaatgtcaagtttaaaatccttctttatttatatactgttccgttcatgcctgtatatttaaaaattctaatataacttttcagagactcatttatactttaagcatggtgtcttcttcaagtttacttattaggaaaatggcatttacttggaaaggtaggcacatattaaaaaaaaaaa

SEQ ID NO: 1256 - DNA, 420 bp, dog
cactagcagacaatacactttaattaccaaaacccaggggacccagtggagggtttttgtgtacttattcctcaacaattaaattttccacaaatagccttgagcaatgacaactctacacgatgtcacttctgaatcattggtaacctgcatttttttcttttatcattattaagcaaagcataacagatatacatttcccattaacactgaattgtttgtggcatgggggaaaatatctcatgaaacattggttaagagaagacataaaatagggtgagtgttaatgatctcttggcaacaataaggcaaattatatgatttaagtgttggcgcaaatccaggcaaaattcttggcaggaaatctgaagaggccttcaaattcaagttgcattaaggttatatatataaaaaaaaaaa

SEQ ID NO: 1257 - DNA, 217 bp, dog
cactagccaatgctatatcctgctttattttacttataaaaatcattttcctactttttcataatattctcttcatggttctataatatttcaatgtgttattctttaagaacatatgcgactgcaatttttcaaatacatttatagttgaaacttaactaaatataaatgttttatatttatttaataaatggaaattttgctttaaaaaaaaaaa

SEQ ID NO: 1258 - DNA, 269 bp, dog
cactagccaatgatttagctggagaccatgtgttaagatattttagaacctaatgagtatacatgttattgggattgaatgtccttttgtctaaatgagatggtgagtgcctttagagattgtatcttagatgttttataaaacttcccacaaaacctatagtatagtatattctatggtagtcacttgatgactacatcaactcatctgaggcttattctttttggactattactctcaatagacagctttaatcttaaaaaaaaaaa

SEQ ID NO: 1259 - DNA, 259 bp, dog
cactagcaaattctaccaatcattcagataagaattaagaaccaatccttcttaaactcttccaaaaactagaagagggggatgcctgggtggctcagcggttgggcgcctgccttcagctcagggcatgatcctggggtcccgggattgagtcccacattggactccctgcagggagtttgcttctccctctgcctatgtctctgcctctctctgtgtgtctctcatgaataaataaataaaatcttaaaaaaaaaaa

SEQ ID NO: 1260 - DNA, 380 bp, dog
tcctggatctaaaaaaacctaccttgaatcccatggtatttcagtttggggctgtatattcttcaatataaattctctccaaacccatcctgccttagaataaatgggataaggtagaaagaaaaaaaaatgaaccagaaattccaaagtagaagaaacacttgacataatcatgtcaaagccaggaaaccaaaaattaatgttttcctataaaggatggaggatgtctagctgtgttattaaatgagcactggagtatgcagaaagggccataaggaggaattactggtgttggaagaacttcagccctagcatttcatgagttttgtgctttcaactttatagttagacaatttcactcctgcaattaaaaaaaaaaa

SEQ ID NO: 1261 - DNA, 217 bp, dog
tcctggacaaccagagatgttgcactctcagtgaaccgggctttcaggtggctgcttctgcgggacttttcttaaatgttgcatgattttttttaaaagtattgattgctcaatattgttaacaaaattgacaacttaaaatagtcaataggtatattttttaaaacccaatttaattggagttaaatcatctgcctatctgtaataaaaaaaaaaa

SEQ ID NO: 1262 - DNA, 176 bp, dog
tcctggagatggctacatccctactaatataatatttttaaaaatcagaacatttatctatgttacttaaaattaaatggattattccttgtgcattgccgaatttgctatttaaaggcttctaagaagcatactcttaactgtaaataaatgtatttatagcctaaaaaaaaaaa

SEQ ID NO: 1263 - DNA, 160 bp, dog
tcctggagtaacaacaatcggtaggtagtagcccgcctgcttggaggcgacaagtgttaacagtatttctgctctaatcttcttcccattctggtttctgtagacaggtttttagaagactagaggcttatggttaggatgtaggctttaaaaaaaaaaa

SEQ ID NO: 1264 - DNA, 172 bp, dog
gccatggccctcagggaaatcatagaacttctctgggtctcccttttctctcagccccttagccctgaaatcggtgggtttgtaattccagttggttgacaacttagcattcagtagtcacaaagtagaacacaaaacaacagtgaaggggaatttctgctaaaaaaaaaaa

SEQ ID NO: 1265 - DNA, 377 bp, dog
ggctatggtaaataacgctgcgataaacataggggttcatgtatcttttcaagttagagtttttgtattctttggataaaaacttagaaaagtggagttgctgcattgtatggtaattctatttctaattttttgaggaacctctttattattttccataatggcttcaccaatttacattcccatgaacagtacatgaggattcccttttctccacattcttactaatacttacatcttgtctttttgataagtcattttaacaggtgtagatatctcattttggctttgatttgcatttccttgatgagtagtgaggttgagcattttttcatgtacctgttggtcatctgtaagtcttctttggaaaaaaaaaa

SEQ ID NO: 1266 - DNA, 333 bp, dog
ggctatgtgtattaaaagttgacaaattgaacacccataacaaataaatttattattaaaaaatatacataccaaaaaaagccttaaaggttttttttctctttttaagtctcaaaggttatactatcttttcttactaattccacttctaagaatttttcctaatgacataatctgatgaacgtattaagatgcttgtataaggatctttttttggatccaatctaaaggcccccaaacagaaaaccgatcacacaaatcgattcctccgtacaagggaacattatataggcattcaaatgactcagagatttatttatggaaaaaaaaaaa

SEQ ID NO: 1267 - DNA, 291 bp, dog
ggctatgtaacagacacaaaataataggaattctatggagtattctctttcctgtaacagtctaggtttaagtgatccagtggaggtagtattttagttcagaattgtcaggaacctgggatgttctactatcttccacgtggtatgacttacatctttgtgatataagataactcacctattgtcaagatgcattggccagaaatcctatatataatcacacctgagtgcaaggaggctagaaaatgcagactctactccagttggctatctcccaatgaaaaaaaaaaa

SEQ ID NO: 1268 - DNA, 286 bp, dog
ggctatggcgtggatggaatgtgagaagtgattgtaatagacctcagcttttgtccatgaattctttcctctggccaccaaccaaaatttggtagggagacatgtagcagggatcgcgcataactattcttgaaaaaattatgatgaatgattattttaatagttgctttggggatgcatcttagcatttttctctttatgcccaatgacctcaaagttttcaaaagaaacttgggcgagtactttcttccaatggtttcaattcaaaaagggggaaaaaaaaaaa

SEQ ID NO: 1269 - DNA, 189 bp, dog
ggctatgtatgaggatgagggggatttaatagcctcataaaagttgatttggtttaaagcaaagttttatgaatctgtaactagaatttgattttaatcccaattatgttccatataaccttttccaaagagcaacctttcccaaagagcaaccaataaattgaaactcttctctgtgaaaaaaaaaaa

SEQ ID NO: 1270 - DNA, 220 bp, dog
ctatttcacgttattaatcccaggtgggttgaagaagtctgaacaatgtagtagaaattggtatttaaataatcttgggatggggaaaagttttgaagtaagatattaaagccttaaagattgataacttatctacataaaaatttaaaacttctgaattttaaatgcaccccaaacacataaattaaaagaatggatggctgttgtatgaaaaaaaaaa

SEQ ID NO: 1271 - DNA, 441 bp, dog
agcagcagcaaggaaaaaaaagctggtatgtaaagaggaagccgcataaggctatcagcagattttttggcagaaactatgcaagccagaagaagtggcatgatattttcaaagtgctgaaaggaaaaaatttccaacctagaacattttccccagcaagattaccactcaaaagaggagaaatagagagtttgggggtaagcaaaagctaaaggcagttttcacaaaatcaaccttacaagaaattaaaggacttcttaaactgaaaaaaaaatagctctaacttagtgatgaggaaaataaataaataaataaataaataaataaatagataaataagtgacaagaaaatatacaaaagtaccaatatcactggaaaaggtaaatatatagtgaaggtagtggatgaatcacttaaaaagctagtgtgaaaaaaaaaaa

SEQ ID NO: 1272 - DNA, 428 bp, dog
agcagcagcactaaagcacatggacaaagaaatatctttgagtctctgataattggtctttaaccttccattaaaatcatcactaattgagactgaattgctgttgcaaagactgggtagaaatcacttcatggcattcattcgctgggtcgagaaagatagtgactctatttcaatctctacacgatactgtaatcctttagtctgccccttccaaaactcagcagcacagtatttgtctgtaattcttaacagcaaaacagggagatttcacgaatataaaaaatgaatggtgtcaagcaactgccagttacatcttcaagaatgttgcactgaatttcaggacatgaatttttaattctaacagacagtcaaccagaacaatcaaaacttagataaacttcaactgccaaaatgaaaaaaaaaaa

SEQ ID NO: 1273 - DNA, 482 bp, dog
ggtgaactatatgttgggtaattttttttttttttttttttttttatttatgatagtcacacagagagagagaggcagagacacaggcagagggagaagcaggctccatgcaccgggagcccgatgtgggattcgatcccgggtctccaggatcgcgccctgggccaaaggcaggcgccaaaccactgcgccacccagggatcccctatgttgggtaattgaatttaaatttttttaaaaagaaaagcttttattaatttcaaattcctttaactgtgattcaaaccccatctggaacaaggaaagaagcaggaaaacaaattctcttaagtaaatttatgacaaaatcaccaaaggatagagttaatatatcttaacagagatatagagagcttatgcaattcaaaacattggaagactgacaaggcaccttgcatgctcatcagttcaatcattttattttgtgaatggaaaaaaaaaaa

SEQ ID NO: 1274 - DNA, 420 bp, dog
cctgcaatagttgaaatagacacaggtgaaaaataaattcagaaatatgaaaataaaaagttaaatatcttctacacctacttttaaggccagagatccataccttctatatattaaaataaacataggatgtctttcaaggacacaagtatagcaagaccagacaatgagttaaatatatttttatgactttgtcacctccgattagataaaaaaaattactaaattcaccaacatactcattttcaggaaatacttattaaaagtcttacctttcacaaaagtgtatcatgttcaaatgtataaaattaaactttatttttattttttattcaggagtttgaaagacaccaaagtgagagttagacaaaccaggttccagttcatgttttactactaattaagcctgaaaaaaaaaaa

SEQ ID NO: 1275 - DNA, 282 bp, dog
cctgcaataaaaggctatgtactgaattttagaggaaactgaaatgtaggaactcagtacaatatcatgctatgttaaaacattgattatggcatttaaaaaatgttaaatatcatgtcaagtgttcacacacacacacacacacacatcccccctgtgggatgaccaaggtttcctattgagtttatacactgagtcaaagcaaaagtctcactttttccagtaaaaaaaaaaaaagtcattaaattttgccttaagagttaatgatctgaaaaaaaaaaa

SEQ ID NO: 1276 - DNA, 210 bp, dog
agttatctgacccacatttatttattgtctttttagagcttttcctctcaaactttgtctatagaagactcagttgggaatgtcttggtttcctgcttacgggttctctggaattttcattccaatatatagagatatacaaacataccttcatgcacattacgtgtgtgcattacaaacagttaaaataaataacctgaaaaaaaaaaa

SEQ ID NO: 1277 - DNA, 155 bp, dog
agttatcaatcgtttgccgtatcatttctttgttttatttacttttatagttcatagggatttgaaaggttaacattttaggttctgtgaccttgaaaaagtgtttaaaaacatcattgaacctaaactaatgattaaatttggaaaaaaaaaaa

SEQ ID NO: 1278 - DNA, 392 bp, dog
caagtttaccataattgcaatgacacctgttgaagtaaattacatcatcagcaagcacaaaggcatctatcattactccaatgttatcttggctttgctaacaatatttgcgtcagcattttcaatgattttattattaattgggtcatattaaatatggagggcaaggatggtagatttgaggcagcatccacaagaaagaatcctaaaccctgagtaaaggcactagaaccctaaaccctgagtaaaggcactaagtaaataccttcttaaccaggtttccggttcccatagatatgtctaaaacctagacagtgagggaacaaccatgtggcctgggaagcaggtaaagataagatagcaagagaccagatttgatagaaaaaaaaaaa

SEQ ID NO: 1279 - DNA, 187 bp, dog
ttattcgtggctgagaatgttcagctatatgatttacatggaaataaagagacgtcaatatgaatttgctctaaaaagacatttttggagaacccactaggtcccttgaacgattagagtggctagaaagaatgaagtgtataataataactgaacaaaacaaaaccagggactggaaaaaaaaaaa

SEQ ID NO: 1280 - DNA, 324 bp, dog; identical to SEQ ID NO: 832

SEQ ID NO: 1281 - DNA, 193 bp, dog
ttattcgcctggctgagatggaacagacagtagcagaacaagatgattctctctcttcacttttggtcaaactaaagaaagtatctcaagatttagagagacaaaaagaaatcactgaattaaaaatcaaagaatttgaaaatatcaagttacggctccaagaaaaccatgcagatgaagtgaaaaaaaaaaa

SEQ ID NO: 1282 - DNA, 138 bp, dog
ttattcgggtgaatttaatttatggcaaactcaaaaggaagggggaagtggtcaggttaagttgaaagaaactttctaaacaatatattgtaaacccagcaaaattaaacaaatccagtattttctgaaaaaaaaaaa

SEQ ID NO: 1283 - DNA, 411 bp, dog
cctctatatagaaaatgtggtcagtgatgtcactttccttgctggtcatcattaggcttaaatgaaatgcagaagctcccatcaaagagtttacactaaaatcttcagggctttaaatgaaagggtaaggccagtttcagaaaaacaactttagacattagcagctccaatattaaataaagctctgttttcctatatttttatgactgttgagaccccgcagggaccaatatttgtattcaatttacatttcatggtttcccattgtttcacaatgagttctaataaatgggatttagtataataatccaagtatgacatagctggtatgctttcatgaatgtttttatgtagattttcctcccatgaacatgagtaaataaatctgtttcctgaattgaaaaaaaaaaa

SEQ ID NO: 1284 - DNA, 315 bp, dog
acgttaggtctgttagtacagtatttcacagggcaattcagagcaaatgaattccctgctgagacagtgtgtacggaatatctctttacatacaattgttcattacatgctttttcccctgaaagataaaaacaaaattaaaatcaaataggctctagaaagaccagatatttgccacccaacagtttctgccaaagacttctcaaatacgattttataattttcctggataacatttttcagtatattaacccttactagcagagtgtctggtacatagtaggcacacaatgagtatttgttgaaaaaaaaaaa

SEQ ID NO: 1285 - DNA, 238 bp, dog
atgcccgtatgatgttgcctgacttattgctagaaagtaatagagctcctaatcctaaattagagctttacattgaacaatgtttagtgagggtattaagctttattcatataatatttaggatgtatatgtcagggcctagcctttagaaatgacgcataatgctaataataatccacccataactaaaataaaacagttgtatttatacagtgttaaaaaccatttaaaaaaaaaa

SEQ ID NO: 1286 - DNA, 173 bp, dog
atgcccgtaattattttagtaagtaaaagggtgttacgctagatccttagagtataaaattgatttgacctctgctttgggaagagagcctgtatttttttaaactgtctcaaaagagggatttgggattttataagttgttaataaatgtctatttttgttaaaaaaaaaaa

SEQ ID NO: 1287 - DNA, 330 bp, dog
atgcccggtcacactacaaggagttcacccactgaagtcccagcttatttcatgccatgtaaatgagaataccgtgggccactgtgggcagaaaggggatggcaagcattacattgaaataatttaatatattattaaatatagaaattattaaatatagaaatagttctatagaaataattatagaaatataactattaaataataggaattaaatataggaattattaaatatagaaataattatacaaataagtctgggtgtacgttcaatggggcaacaaaacaattatagttcttgaaagaaaagactgatgttaaaaaaaaaaa

SEQ ID NO: 1288 - DNA, 228 bp, dog
atgcccgctcagacctcttggcaggcttgggtactcaccggctttgtaggtggtagagaatgttggtgggagagtaaccccacagggtaaaataggagaccctgcttaaaataggaggccctacctagttagcaaagaggtatgaatgtctgccaaattgtaaaggggccgtgagtggttgtgaggcatatgtgattctaaggtaaataaacctagtaaaaaaaaaaa

SEQ ID NO: 1289 - DNA, 195 bp, dog
atgcccgtagtcccagctactcgggaggctgaggtgggaggatcgcttgaacccagaaggcggggattgcagtgagccgagactgcatcactgtactccagcctgggcgagagagtgagactgtctcaagaaaaaaataaataaataaattctgttttgcaatccaatgatagttccaaactgtaaaaaaaaaaa

SEQ ID NO: 1290 - DNA, 175 bp, dog
atgcccgcagttctgtattttaccaccaggtggaagtagtctcattaaagatagtaatcaactcattcactcatttattactgagtgattccttgtttattatttgcaaataaaaagctccatctttcttaccttacatttcagtggggtaagatcagcaaattaaaaaaaaaaa

SEQ ID NO: 1291 - DNA, 168 bp, dog
atgcccgtaccacacaatttactatggttgtttttaactaatattttccagattatttgaacccaaaataccttttgggataatagaatgtcctaatgaatattttagaaagtttaaaaattagttgatctttttttataaaaaagtgaggaaaggtaaaaaaaaaaa

SEQ ID NO: 1292 - DNA, 157 bp, dog
atgcccgctcaggaatgaagattgggcggattgaggatgtcacccccatcccctccgatagcacccgcaggaagggaggtcgccgtggtcgccgtctgtgaacaggattcttcaaactattttctgttaataaattgcctttgtgtaaaaaaaaaaa

SEQ ID NO: 1293 - DNA, 139 bp, dog
atgcccgtagatgctactcacaataaactagaagagacaaatgctcaggtttgcttcattagggatctatcccagaggggttttaattattcatttgatgttctgattatatttgcagacttctttataaaaaaaaaaa

SEQ ID NO: 1294 - DNA, 274 bp, dog
gcggtgaggactgtgttaatgaggaaaggacttaaaacaatgtctgatatttagtattcaataaatgttaatgattattattactgtagtagtggtggaaagtctttagagattatctaaactggtccttgctgtcaagttatgaatgtccaaattatcaaagatccctatctgttttctgcatcaagaatgaaggaccattttctttttaatagtgcctgctttactgaaaaaaaaagtcaagacgacctatactcaaatgtaaaaaaaaaaa

SEQ ID NO: 1295 - DNA, 216 bp, dog
gcggtgagtactgtctctgctttcttcatgtggcattctctattccttttatatctcaaatcaaaaaccaatatgaaagccggcctgccttatttggatggggagagactgttggttgttatagtctttgatgccttattaaacttaaaaccttgcttctagatcaagtaaagttagaaataatgcttcttttatactctaccataaaaaaaaaaa

SEQ ID NO: 1296 - DNA, 181 bp, dog
gcggtgacaatgtaatataaaaattggcaaaatagcatgccatttataggaagaaaaaaatagaaaaagcaacaagtaaaagtttcaaaagattcttagcctcacttataggtgaagaaaatgcaaattatagcaacaggatactattttgaaacaactttctggtttgtaaaaaaaaaaa

SEQ ID NO: 1297 - DNA, 217 bp, dog
cctctataaatagtgtctagaatgaaaactaatttagaaacaagactccaagattcaagaaaacccttagtgaatatattcttgatcattaatattagcccattatattttcatctgtatttgccattaaaaatttatttgcatttatacctttaggataattgagtttgtgtctttctaatctattttatcattgctacaggtttaaaaaaaaaaa

SEQ ID NO: 1298 - DNA, 206 bp, dog
acgttagacatggagattactttttttttttttaacaaaaggaaacaatggttaagatggtcctttttacattgtgtattttactacagttatcaaaagaaaaagaaaaatgttaaagtcccactgataaaaccagtttaaaatagtagggcaagtaaaattctttccagatctgaagtagatctctgtgaacctaaaaaaaaaaa

SEQ ID NO: 1299 - DNA, 191 bp, dog
acgttaggcataaatacatgagggttatatattaataagggaggaagtcttctgtttgacattattaacattcctgttttcttcctattcctcccagaggaatacacattcacctttaagtaaagataaaggaattacaaaaaaataaaactcactttgcaaacaactctgatgacttgtaaaaaaaaaaa

SEQ ID NO: 1300 - DNA, 457 bp, dog
atgaagggggtcaccaaagccatgggcaccatgaacagacagctaaagttgcctcagatccagaagatcatgatggaatttgagcggcaggccgagatcatggacatgaaggaggaaatgatgaatgatgccattgatgatgccatgggtgatgaggaagatgaagaggagagtgacgctgttgtatcccaggtcctggatgagctgggattgagcctgacagatgagctgtcaaaccttccctccaccggaggctcactcagtgtggctgccagtgggaagaaagcagaggctgctgcctcagccctagtagatgccgacgcagacctggaggagcggctcaagaatctgcggagggactaatcaccctatactaccatgagtgggaggtgggcaatcgatgcccagttttgctgtactacttctgtaataaaagattggacactaaaaaaaaaaa

SEQ ID NO: 1301 - DNA, 317 bp, dog
atgaaggcgatgagaaattcaaaagacaatgaaggagatggcatttagtctccagaggctttacaaaacactgactaggtatgtgtgcatatctctctctctctctctcttctttctttcttataaagacaaagccctaagtgatcccatgacactcaggcattagagtaaagcaagtgttgatgaaatgtttcagagcctattataggcggtggttgcacagcacagtgaatgtactcactgtcactgactagtacactttaaaatggttcattttatgttgtcttgtgtgaactgcatcttgataaaaaaaaaaa

SEQ ID NO: 1302 - DNA, 240 bp, dog
atgaaggatgagctgaagaaaagactacatttataaagcacttttccaaaacagataagcatttgtcacatccacttgctgttacaatttccgaagaaaccagctgctcagcctgccccaaagatttgccctacaattctgagggaaggagtgaaaagtaaagctgatacctatgttgataagtaaatccaatggatcaaaagataaagggctttctgtattctgatttaaaaaaaaaaa

SEQ ID NO: 1303 - DNA, 195 bp, dog
atgaaggcagggtctgctctgttttgtttactactgtattgctaacatctggaatagtgtgacttgcatagaatatttagtaaatatttgtgaaatgaatgaataaataaatgatgagtgttccattttctttgaattatgttggcaggtattctatttaagtagttttttattaagtcactgtaaaaaaaaaaa

SEQ ID NO: 1304 - DNA, 199 bp, dog
ctagcatcaagaaagtagcccaaagggcgcctgactggctccgttggttaagtgtctgcctttggctcaggttatgatcttggggtctgggattgccccgctgtagggctccctgctcagcaggaagtctgcttctccctctgcccatcacccttgcccactctctcaaataaattaataaaatctttaaaaaaaaaaa

SEQ ID NO: 1305 - DNA, 224 bp, dog
ctagcattagcaactaaaaacactcggattgtcttggctggtgaccacatgcaggtatgtgccctctgagtcaccatattgaaggaactactaattatatcttggtgtttaatattctgtgtcctaaaacctctatgaaattgtgtcatatattacagttcaatatttctgcacaaatagtgaaaaatattactttctctgaaggaaaattactaaaaaaaaaa

SEQ ID NO: 1306 - DNA, 199 bp, dog
tcgaatcatacactttatataaaattggttccattttttaatgaaccagaataaaggattgatggacaagccaatagaaaaaaaccttgattattgataaattaatgagtgcttttaataatattagattgcccaactgtatttctttttttagttgggttttatagactgctaagtgtgtttggtttaaaaaaaaaaa

SEQ ID NO: 1307 - DNA, 143 bp, dog
gttggtagtgtaagtgaatatcacaaagcaggaatggaatttggcagagctgggttttcaaaataattactttacagtccaactgacatcttttttaatgcaatttccccctagtaaatttggggtggcggtaaaaaaaaaaa

SEQ ID NO: 1308 - DNA, 421 bp, dog
ggctatgtgcacagagtctggatggaaaccagggagacagaagtgattgactgcttttcccctgagggtgcactgaagagtaggggccttaatttttctgctctggggctgaaggagcaccatatttttattttcatcctaaagtggcacagaaagccttcagggaacaaaaaccacatagagcaatcaggagcaagcttactctgagcccagcgtcctggcaaggacagtgcaactccacctcagcaaagacactggagagtcagcaccacaggcccctccccgaggagacccacaggaacttccagcaaataccatgttttctgattacacagaactgaaaaactccaggggaaaatagtatacagaattcgaggttttctttttctcatgatttagtcttttggttgaaaaaaaaaaa

SEQ ID NO: 1309 - DNA, 157 bp, dog
ctatttccctcctcctgacttttcatccttactttatattatcattattttattgtacatattccttgtgagtgacctcaaatcctttagggaaagaaataatgcataaatatataaactaataaaataattgacagctggttatgaaaaaaaaaaa

SEQ ID NO: 1310 - DNA, 222 bp, dog
tcgaatctaaaagagttctatgaattacaaaaagcactctgctatcccaaagagaggctttataaatagaagattttgtatataagcctatttatctgcagtcttgtaaagagttgagcactgtctagagaatgtgatctaagtaggcaaacaattcagataatgtaaattgcagtttgaggtctaagaaatagagaaaacatgtttagtctaaaaaaaaaa

SEQ ID NO: 1311 - DNA, 262 bp, dog
tgcaccgtatctgatcataaaaaaaaaagctgtagagttttcaaacttgaaataattactgaaataggaaaagcaaaatgaatgtaatttacatttctgcttatattatatttattgattatattgtttttcctttcttaggcccctaaaacttttatcattgtgatatataaaagtaaacatttgctacaaaatgaaaaaattactgagtagatttagtgtgaaaaaaaaaaagcttaagctttgcaccgaaaaaaaaaaa

SEQ ID NO: 1312 - DNA, 140 bp, dog
acggggtatgaagttcccacctggggccacgagaaagttctggaactgaaaagtagtgccagttgtataacactgtgagtgcacttaatgctattgacatgtaaacattaaaaaggttaaagtggttagaaaaaaaaaaa

SEQ ID NO: 1313 - DNA, 300 bp, dog
gttggtagacctgggaaaagaagttgaagataaaagaagatagataaccaatattgggatattccagaggagcagtgagtggatggttttaagagtatagctgaaaagattagtcttcaaaaacattctcctttctgagctgcttgcaaatgttaataaagacagatagatacagatagaggaggggctagaaattgtgtgtaacactcaagtttgctttttcagtagaaggcaaggttggcttttgagagtaagcaagtagggtggaaatagggtataagagattgggaaaaaaaaaaa

SEQ ID NO: 1314 - DNA, 503 bp, dog
ggctgacgggaagtggttgttctatgtgattgcttaggggacatatttggccttctctggttggtcttaagttggaagtgatgacaaaaattgaggaaactggcatttatagaccaagtgctgaccatttccatcccctttttttctggttatagaccttcaatccatagccatagacatgtacacaaaaacccaacctggccaatcatggtattccatttgtttggcaatcataattggctcaaaaagtgactgtgtgatccaagcagggtcaactatataacttctctggaattgatgttgacattaaaagaaagaagttttgcctattgtagttgctaattagagagactgtcgatttggggctgccggtggtcatcttttccagtatgtggagagtctgtttacagaatgaagctgtgtagtaaaggattaaccttagccaaagaaagatctggacattgtcgtttgctcctggagggtgatctgtttaaaaaaaaaaa

SEQ ID NO: 1315 - DNA, 509 bp, dog
cggtccttaccatcaatttgtcttctgtgtcagtcactctctcttccatttcattaaccctagcagttagaacatccagtttggatagcatctcaattaatctatttttaatttcggctttagtagatttcaattctgcaataacaatgtctctagagtccgcttatagtttttttccagaaccaccagtagctttataattgtacctctgggttgaatttctgacatcatatttaaatccagattctgtaacttcttggcagagagtactttttctggttctttcttttgtggtgaattcttccttctagtcattttgttcagtgcagagtggctgtatgagtgggatgagtcaaaaatatcaactatgacctaagtaaaatatgccctagatgattctgaagagatcagagaacagaaaataatgggaaaaaagaacagaacaaaataaaacaaaaggacccctaaagtaaaaaacaaattttaaaacaaattagtaaaaaaaaaaa

SEQ ID NO: 1316 - DNA, 179 bp, dog
cggtccttatctctgggtcatgagatcaagcccccagtagggctccatactgggtgcagagttggattgagagttcccccttctgctcctccccccacactcactcttgctctctcctcctctctctcaaatgaataaatcttttttaaaaatatccttatggtacttaaaaaaaaaaa

SEQ ID NO: 1317 - DNA, 287 bp, dog
ttgatcctataataaacttcacttagtcataatctaatattttttaatacatagctggatttgacctgctactatgtggcttaggaattttgcatctatctttaagagagagattgatttgtaattttcttgtaatgttcttgttagattttgctatcaagattattctggtctcatttccattctctcaacaaccgtagaacctgtttgggaacatacatagtcattatatcataccgtgtcttggtttgcaattaaatattattgtgtgattgtaaaaaaaaaaa

SEQ ID NO: 1318 - DNA, 303 bp, dog
cactagctatgcacttattcaggatatagtcacctcattttaaaaaaattttatttatttattcatgagagacagagagagagagagagagagagagagagaggcagagacacaggcagagggagaagcaggctccatgcagggagcctcacgtgggactcgatcctgggtctccaggatcatgccctgggctgaaggcggcgctaaacccctgagccactcaggctgcccgatcacctcatttttgatatctgcagtgtataataagcactggcaagaatgaacacatattaaaaaaaaaaa

SEQ ID NO: 1319 - DNA, 244 bp, dog
cactagccaaaggggtggatttgggaattgccaggcttccctgagcctctattttttcagtcatgaagcattggggcacttgggtagctcagtgggttgagtgtttgccttggtcctgggatcaagctccacatcctgctccctgctcagtggggagcctgcttctccctctccctctgctgttccctcctctttgtgctcacgtgctctctcatcaaataaataaaatctttaaaaaaaaaaa

SEQ ID NO: 1320 - DNA, 269 bp, dog
tcctggaggctgccaagaagatctatcagaacattcaggacggaagcctggatctgaatgccgccgagtctggcgtacaacacaaaccttcagccccacagggaggccggctaaccagcgaaccccaaccccagagagaaggctgtggctgctagtgacctctttgccgtcgctcccatttgacctttcacctctgtctgttggaagcagttctttttactgcctcattgtcttctgtacatcttactgggtttaattaaaaaaaaaaa

SEQ ID NO: 1321 - DNA, 237 bp, dog
acgatgcacatactcttgaggaagtagcagactcgcgcataaatgaaaaccaatggatcagggatgcctgggtggctcaatggttgagcacctgcctttggctcagggcgtgatccccaagtcccgggatcgagtcccacatcaggctccttgcatggagcctacttctctctcttcctgtgtctctgcctctctatgtctctcatgaataaataaataaaatcttaaaaaaaaaaa

SEQ ID NO: 1322 - DNA, 239 bp, dog
gctgctcctgtaagacttctagcctcctcattggcacatttgcggcacattacaacttataggatagcattcgatgtggatttccactctccatttctcttatgttaaagtgaaagatttaggcactatgtacaattggtaaagaagaaacattttcataagagttataactatatgtaaacgttgtataatggtatggaataaaatgcacattgtaggacattttctaaaaaaaaaaa

SEQ ID NO: 1323 - DNA, 154 bp, dog
gggcctaattttacttacattgttttgcatgtttgtatcagaaattcaggagtattttttttgaaaactatatttttattgaaatttggagtttattataggaagttagttgttggatttttcaaaggaaggaagatggatttaaaaaaaaaaa

SEQ ID NO: 1324 - DNA, 251 bp, dog
tcccagcatgaggaaaaatttgagtttggccatgtgggcggcttccgggaagggtccagcactgcttgtcctcagtggcctcacagggtgactcactggctggcagacgcgcctgcccgtagatgctactcacaataaactagaagagacaaatgctcaggtttgcttcattagggatctatcccagaggggttttaattattcatttgatgttctgattatatttgcagacttctttataaaaaaaaaaa

SEQ ID NO: 1325 - DNA, 165 bp, dog
gtcagccataggaatttctagtttgaacatggaggccaatacacaatggaaggaaattcatcaagaaggccaggaaactgaatttttccctcctggagtaagtattttgtagtctctaatgctgccactcaaaaaatgggaaaaagtcactcttaaaaaaaaaaa

SEQ ID NO: 1326 - DNA, 134 bp, dog
acggggttaagtagaagacgaatgttctaatgtcaaccctgcccagtatgatctcaaatgcaactttccagaaagaaatataaactagccattgacaaactaataggatattttcttcatcctaaaaaaaaaaa

SEQ ID NO: 1327 - DNA, 159 bp, dog
ttgatcccagggtcatgaattcaagccctatattggagcctacttaaagaaaaaagaatgcataatggtagaataataaaatagacaatgaaggagaccgacctctggaaaaattaaaaagagagagactacctaacaatacaatgtgaaaaaaaaaaa

SEQ ID NO: 1328 - DNA, 886 bp, dog
cactagcctattgctgaaaagtaagatttatgtttgtttttatcatcaactattgctacaagtgtgaatattaaagcataaactttaactctgcacttataggattacacttgtttgtcaggggggaaaaaaaccatcagttctgaagatgtaaacaaaaggacaagaggagcaaggctcattttattctccgccttccgtgatcacttagattttatgtggtttactaagattctaaggaagattcttgcagggatctcagaaacccaatccaacaggaagcccccaccaaacaccaggcactaggtagggccccggggtactgagataggaccctctgccctcttagcatcctggaacaaagggaagcaaatgctcctaagtccttacggctatagtttaactgaagagagttgcttacatgagatatcgacacaacagccaccttctagtctgggttcagagagggaggaaaaagccagttccaggattagaacactgagaaatattttggtttctgataaatgttggtataatattaaaaccagttaagagtgatcaaaggaacctaaaggagaaacactgtggtcactcttccttcatgtgccattagcatttgcccaagggctgcctctgtgacaaatcaaaatggcttgccccaggctctgcttgcagaagcacaactgattttgcaaacatgttatattccagtgccttttataagatttaatatagttcttccttatatagacactttctcgacaatggttttaggtgatcactatctaactcccaattcttactccaggaaaccagttaagaatccttaacagaagaaacaggacaaccagttacccagcccccccaccaggaaggaaaaaaaaaa

SEQ ID NO: 1329 - DNA, 220 bp, dog
cactagcaattccttcttggatctgatctcattacgactggggttaagctaagtttccctaacatccactcttaaatatataagaatgcacgttgcagagaaagtttgcaaatagttcagcacaagaaatatgaaatttggacaatgagatgaaggtattcctgctatacaaaaatctttgggtttttgatatccaacaagaagaagggaaaaaaaaaaa

SEQ ID NO: 1330 - DNA, 196 bp, dog
gccatggaaacaatacacaggataccttttccttaattgggtgggattttttcccttttatgtgggatagtagttatttgtgacctaagaataattttggaataatttctattaatatcaactctgaagcttagttgtactgatctgaaattgtgtttgttcataataaaagtgaagtgaatctgaaaaaaaaaaa

SEQ ID NO: 1331 - DNA, 138 bp, dog
ggtgaacgctgggcagcagtgtgccgttggacagaggaacgttggagtaggctacaagaaattaatatattgtggcaggaattattagaagaacagtgcttgttgaaagcttggtgaactacgagtgaaaaaaaaaaa

SEQ ID NO: 1332 - DNA, 162 bp, dog
agttatcaaaagcagttggaaaatgtttgcaagactatgaacatagaattgctgcttttatattttaactgcagattgtgaatttcactgccttatattatttatttctgaaacaaaagaggcatttttcaataaaactactgaaaatttgaaaaaaaaaaa

SEQ ID NO: 1333 - DNA, 132 bp, dog
ccagtgcacctagaaaatcggtctctcttttgtttttaatagctatttgctaaatgctgttcttacacagaatttcttaattttcaccgagcaggggtggaaaagtacttttgctttcaggaaaaaaaaaaa

SEQ ID NO: 1334 - DNA, 154 bp, dog
tgcaccgaggagccacgtgccaggctctgccctgctcatcctttagaaggtgccagtgactacctgctggcttccagggagcctgtaggctttttgatctgaggccctgaggtctccagacagcaataaactatctttcttggaaaaaaaaaaa

SEQ ID NO: 1335 - DNA, 182 bp, dog
atttgtgtttttagtggcagaaaggaatttccttgggagtttaaaagtcaagtaggtcatcatagattttgtggactggagataatttgccatcctaaatttatttgcatgttaaagagaaattcaaagttcagtactttctatagaggagttttgtatatgaaacctttgaaaaaaaaaaa

SEQ ID NO: 1336 - DNA, 258 bp, dog
gaagcggacagtagtcaaccatttttctggctcccttttctttggtgctcaattttactgaccattgggaccattaaaaaaggttaggtcaagtcaattagccgttggatttttccttagtttacatatgtgtcacttagtgtgggttaaattatccttgaataattaaaaatatacatacatgcacattataaacacatttaaatttctattccataaaatacttagtgccttcttagtttataataaaaaaaaaaa

SEQ ID NO: 1337 - DNA, 184 bp, dog
gagtgctgcaagaggggtactagcagtgtgcgccccggagcacgggaagaaagcccacagaaccatggaaatgaggggagcctttgcagagggtgtgacaaaagtcagcttgacattttcaggctatgtacaatgctgcacaccttgtaatgctcaataaagtaatcatcgacaaaaaaaaaaa

SEQ ID NO: 1338 - DNA, 331 bp, dog
cgaattcaacagagaaaacatttccatccttgtactgaagtcttgtggtccacctggaacagccagacaagtagctcttctaagttcacagtctcttagaccttttctactactacttttagagtaacctctagggaataatattttttgtataattcataaatctctaatcaaggacaaggctaatacagtcaaaaaaaaaagtcaaaaaaaaaaaaaaggctaatacagtcataaatccgttttctgaactctccttcacatgaataattgccaacccattaaggaatattctaacataataaaagtaatttctgcataaaaaaaaaaa

SEQ ID NO: 1339 - DNA, 389 bp, dog
ccagtgcaaccgctccaaattaaattggaaaaaaaaaaagcttaaataaaatcacagatacataagtgagcagaatgaatcaggcaatgccaatatttttattaaagctagagaagatgaaactgggtgtaagcagtgggcaatgtggctataagtgagcaaggctgtgttgcataaaagaccctgggtatcaccgtaagagttttagtctttatttcactgtctccagatgatcttgttggcaaaaaaactgaaagcgaatgagatttgggcaattttctaaccttgctctaggtggtctctgtaaaacttaagggaaaagtcattaaaaaaaaaagaagaagaagaagagcagttatccaggccacttctgtgatggaaaaaaaaaa

SEQ ID NO: 1340 - DNA, 246 bp, dog
gcctttattctatttttaatcattcatgtaaggcctaaatagcacccattaagtacttttaaaataatgattctatagcatccctcaatagtatttttaaatatattaagtattatttacttttacctagtttgaaatgtaatgtctgacatgaatggattatttgctaactaaagcattaactgtgaacctaatagctattgtcagttgctagttttctaagaaatcattatagaaaaaaaaaaa

SEQ ID NO: 1341 - DNA, 746 bp, dog
gcctttactgaaatgttgctgccttcttgggaagaagggtagtcttgtacaaagaaacaaagacatctacctatatagagcttaaatttcagcctaatatactctaatagacaatgaaaaagatatatgaagaactatactgttatctgggaaactggatggcaatagttaagaggaaaaaaaggagatgacatgtgcaggccagaagtgagtatttaacattttcaactgaatgtctatgaacgaactcactgtaaagctaaacatttgagaaaatatctaaacagaatggagagcctcacaaacaaaaaatttggtcaaagtcttcaagataaaggctctgaggtagggcaaagtacacctggtttcttctagaaactttgaaggcattcttgctattttagtgtgagtcagaaggaatatgatcacaatgagcctctggttaaatgcttacctgatctagcccctgaaaagtctatttccatgaaccttcaaattcttgggtgtgtgtgtgtgtgtgagagagagagagagagagagagagactgaaagagattgaaagagagaaggagggaggaatattctgtttagattttctgttgttgcaactaaaatttaaaaatgctaactcctaccccaaatgcaaattgtattcatatggaattctaatttgagctttacttctttcagtgttcagtgtgagtttgcataagtcacgcgtgctgaaaattattgaaaaaaaaaaa

SEQ ID NO: 1342 - DNA, 343 bp, dog
gcaagttactaaacacaataatgctgttttattttctcttaacatcacttaaaattcacaagaaaataatgtagatagaacaaattgcagacaaggaaaaaaaacttgaatgaaatggattttacagaaagctttatgataatttttgaatgcattatttattttttgtgccatgcatttttttctcaccaaatgaccttacctgtaatacagtcttgtttgtctgtttacaaccatgtatttattgtaatgtacatactgtaatgttaattgtaaattatcagttcttattaaaacatcatcccgtgatgggatggtgttgatatatttggaaaaaaaaaaa

SEQ ID NO: 1343 - DNA, 562 bp, dog
tgaattctgggcattttaaaggtcatcgggaaagggagaataatccattaatttttactagtgttcatttaagcatcctccatgaaaatcaatataaaatttccctgccgttcaaaatgcaaagtggtgtataatatcactactccaaactgccctaaattgttgaatttttaaacaagccagctttgagttatgtccttaccacataaatttagcttctcagattggattattgccatatggttgcaatagcaagaaaaataaatttatgtcaatctgaattctacttctgcatttattatttaagctgcccttaaccttttcctaggtcagtgatcatctcatggatttgctcttattcgtatacctcagaggacaaaaattcctttctttatgggtattatttataagttaaatgttacttctccacttacattagtaattatttacctgctttggaattcatacattacaaatttgccaaatgaaagttgtcagatgggtgcatatatttgtgctattcctctgttgcccattaggagctggtttggaaaaaaaaaaa

SEQ ID NO: 1344 - DNA, 124 bp, dog
tgagactgtgaagtggtaaaataaaaaaaaatggttgagaaaaaaaaaaaaaaaaaaaaaaaaaaaaaaaaaaaaaaaaaaaaaaaaaaaaaaaaaaaaaaaaaaaaaaaagggaaaaaaaaaa

SEQ ID NO: 1345 - DNA, 402 bp, dog
aggttctttcccgggcccacagtatgagccttccctttgactccggagcgcttcctgggcgacccagacttgctctcacggtgtcacgctcacatgtgtctgaacaaagcagtcaaggactctggtctcgggatgcaggccgcgttcttgatgaacaaccctcagagatacctggggtaggagcagcctctgggaaggcagcgtagcagtcaggcagcgggttgcttgccctgtgggttcataccccgtatcttaaaagtttctttcccatgatggttgtgccttcagatcctcgtgttcgtgcatattgataagatgacactgattcccttcctaggattctatgtctgtatttctagtaaagtcttagtttcccaactgagctggtaggaaaaaaaaaaa

SEQ ID NO: 1346 - DNA, 727 bp, dog
gccatggtgactacagtgggtactatattgcatattttaaagttgctaatacagtagatcttaaaagtcttcattacaagaaaaaaaagaaaaatttttttctatgtatggtgatagacttatttactgtggtgatcattttataatgtgcacaaatatcaaatcattatttgcacacctgaaactaataaaatatgtcattaatagtttttaaagagcctggacaagcatgtggctttaagatatataaaaacattaccatttgcatagcaaccaaaaaagaaagaatacctagttaaacttaataaacaagaaactaggtcatataaagaaagctagaaactctgaagggtatacaataagatttaagcaaatgatacaactatttttgtatatgcagtatttacagtatgtagatgtttattcttcatagagaataccaactaaaatatcaatatgtttttacgagaaaactaagaaaatttgaagacaaactagtcttaccaaacattaaaacatattataaagccaaaaaaatttgaactggttagcactaaaagagaaatgaataaaccaacaggacagaaataatacatccagaaatatacccagacatatacaaatgagtttcattctactcaaaagtgacccttcaaatcattgtgaaaaattgggtattcaataaatgacaattaaaataattggctaaccatttgaaaaaaaaaaa

SEQ ID NO: 1347 - DNA, 383 bp, dog
tttttttttttagaaacaatggctgcttgctagtttcaaatgtcctaacaaaaaaggagtcactaccccaaatgttggagagttgcaacattttataaaatcggctgtctccttttctggagatgtttatttcttaaaactcaagatatttttcttgaaattaattatcctctgtagaaaatgcttccctttgcaaatatttaacaaaaatactaaaaacggtttaacagctaagacaaagtagaggccaaatactattacaattccttcctatttgtagcatgccttctttctagagataagtaaagccaatattgcatgttaatggcaactaagggaaagcgcaaaggggtaagtgaaattttagctgttaaaaaaaaaaa

SEQ ID NO: 1348 - DNA, 889 bp, dog
tttttttttttagttttcttaattgtctttgtctgttttgcactttctgcaggtgtttctaaactttattgcccaatctttctgttagaaaagaatttctcggatacttaatttttcagtaatcctttgttccctcaatctttcttttcttatagtctcttgttttatgactgctgtatcttttcatctctcaagataaacactgcaggaagagaaaacagttgttttactccagtttttcctgtgttgggctctcacaataaaggcttttctcaaatgtatattgatctttggttgtcagcttatatctaacaggatggactactgaacgtgtgggtggagcttgtcagcttcattgtttggctggccttcaatggctgtttgttggatgactctgaggtatcttttgaacaggtcagattccccgaagaatattctttgagtttttgactggagaataaaagggcttggatcattattctgggaactaagtaagtgaagaaggaacacaagggtctcattcagtatgcatttttttcttaatctctttttggtgtggaaccctcacctaaggctgtgtgtttgtccttcagtccctaggtttctatccgttttgtccactccagaggataaacttctaaactcacatctaggaatccagttttccttgtatttttgacaaaccttattctggttctcacttcacccccactttcagaggtgtacccagtgttcccagttctcagatcttttgaggaattctccagtgtaagtatggttgattctcggttttccatattgcttctttcttccatctgcttgcttgcttctaaaattgaattgctgttttctctcatcttactcagacttgtacctttaaaaaaaaaaa

SEQ ID NO: 1349 - DNA, 324 bp, dog
tttttttttatttaaaaaaagatatattaacagttttagaagtcagtagaataaaatcttaaagcactcttataatatggcatctctcagtttctgtataaaagcagatctttaaaaaaatatttctgtaacttaagaaacctggcatttaaatcatattttgtccttaggtaaggtttggtttgtgtttgtgttttgtttgttttgcttgtcccctcccccccaaaccttttgttctctctgtgaactcatctttccttttttctttctttttttttgtatattattgtttacaataaatatacattgcattaaaaaaaaaaa

SEQ ID NO: 1350 - DNA, 639 bp, dog
tttttttttttaaccaaagaagaggtgggagtggtttagttctcgtttttaattcagcttagaaactattgaatctttgcccaagatttaaggtgacatgtttttcctttcttaaaaactttagagtcagagaaactaggtatgttattgtataagatttttaatattagcattttattactatcatattttattgtaatttttggcatgctgtcactttttaggagcatagagtcttttattttttttttttcatttttgagtaaagtttttctgggaaaaaaattgttaaaacaggtaatgcataatacattttagttttaccaattaggaaatccctccagaaacaaataagggtgtagccttttggatttttacaaaaaaacacatttatatatatccattcttttaaatagacattgtagaagaaattattagcttttttacacccgttaccaattgaagttttaagtatgcaattagatattttaatttatgcttgataatatattttttaagaacatgagacttcgaaacatcatttttaaagctcaatttgtttgtaatacatttgcatagataatagagcattaggttttcttggggtggtttatgatgtagtttcactaaaaaaaaaaa

SEQ ID NO: 1351 - DNA, 163 bp, dog
ccagtcaggtggttacagggaactcctcatgatgctgtaggtgtagggtcagagaactttcttcttctgggcctcacttcaagctagctagttttcaggtcacttgtcagtgggtcatagtaccacaaaaccataaatatgtatgttatcaccagcacctggt

SEQ ID NO: 1352 - DNA, 552 bp, dog
ttttttttttaaagcggagtggaagcctttgcttccacctttgtgtttttaacccagaatttctgaaatagagaatttaggaacacatcaagtaataaatatacagaaaatatacttttttataaagcacataagtgcgtatgctattgtgttgggttggtttcctcttttttccacggacagtgttgtgtttctgttgatagggaaactccaaagaatttgcacacctccactccggagctgagatttcttttacatagatgacctcgcttcaaatatgttaccttacgggataggatcttttcttgtagcactataccttgtgggaactttctttctttctctctctctctctctcttttttttttaacgtacacctaatttgagaagctgaagaagaaaaaattttgaagcactcactttgaggagtacaggtaatgttctcaaaaattgcacaaaagaaaaatgaatgtcgagatgattcattcagtgttcgaaagacatggatctgttgaaacaatgagtttaataccttgtttgtaaaaaaaaaaa

SEQ ID NO: 1353 - DNA, 269 bp, dog
tgaattcataatatcctgtaatctttacaagatcctgagcaggtagatatatttttattattaatcccatgttacagatgagggaaggaaggcagagaaatgagaaataactagcttaaggtcgctcaggtacttatgatgcaacattctagtctttgcctacttgagttcttaactagcttaaaatgccttaagatatgttccatgtgctatagactagctttaccagaaatgatgactttttcttaatattggtggcaaaaaaaaaa

SEQ ID NO: 1354 - DNA, 61 bp, dog
tgaattcatggcatgataactgtaaaaaaaataaaagacctcacgattgtaaaaaaaaaaa

SEQ ID NO: 1355 - DNA, 762 bp, dog
tttttttttttaagaagggatttcaagagaggcaagaggggaagcaagatgccaagtagaaaccttactgacaactctgctaactcacggattcagaattcattttacattgccagcaactgtgttgtattaagacaaaggaagaccaaactccactagtgttttctgtaccccatcccttgtggagaaaaaaaaaaaaaagacccaagtgaaaaagtattcctgtttttcgagtcttttagatggcataagaactccaacaggaaagtccaatatggaaaagcaagcagaagttccctttgcaaagttttaattttattttaactttgctaaatctacttacattcacattttgaaatatgcatgcatgataaaacactgcagttatggtctattgggttaaaaatccactttttggaacgggttcaagggaatacttacacaaaagatctcagaatggagagtaattctgtagataaaatagaatggaaacattccctaaataagcaagataaatgcaccgtgagagggcctggaaccatcagtgaccggttcaaatcagctggcctttcagtccctcatcagtgtcaatgttcgtacctttccaaggtgtcacctctgctgttcataattcaggtgaagccaagaaattgaccctcaatataagacagtgaaattccattctaacatgctactcacaaagcacagggtgaccatggtgctattttgcaaagttccacacaaagagagctaaaaaaaaaa

SEQ ID NO: 1356 - DNA, 552 bp, dog; identical to SEQ ID NO: 1352

SEQ ID NO: 1357 - DNA, 515 bp, dog
ttttttttttagaactataaaaatactactttggagaactccaacattacagaaatgtgacttcagaaatccaaagttactgcccataatcccactccacaaaattactataataactataaaatgtttattagttcagaatatttttcctatgaaaagactaatatatataaatgcctttaaaatacacaaattgcgtcatgccacatgtcccattcttcatctgtatgtttatctggctggtgtgcagtgatgtctgttacaaagatgttcactgaaaacctagttgggttttgtttttgtttttgtttttgttttttaagctagttttagggatgcctgggtggctcagtggttgagtgtctgcttttagctcaggacacgatcccagggtcccgggatcaagttccacctcaggctcctcaccaggagcctgcttctccctctgcctatgtctctgcttctgtgtgtctctcatgaataaataaataaaatcctttatttaaaaaaaaaaa

SEQ ID NO: 1358 - DNA, 732 bp, dog
tttttttttttaaattagtcttagaaaaataaaaagttatacaaagagtaattaagactaaatatgtgaatgaacagtctccaaataaactccattacttccaatactaactcctccaaaaacaaattatttcaagaatgaatataaccaaaattgaaaagttacaattcctcaaaatatttagtaatataaaacaaaaatgtgtaccacattccttactatattcagtgttaacaaaatgtactaccctaattcctttctttctacccttcccccaaattactagatcttaaattattaacgatttaaatgaaaactttcttctttatgataagaatgattttttaaaactgaatcaacggagagtcagcatttattatatcctagagggaatgcaggatttgaagtcttatttaatttataaataagcacattatgtgaaaatttctcctgcaaaagaattatggagtatccaatgtaaaacggttctcaaaaacctttaaaacagaaaaattactcctcaaaacttcaaaaagtggttcaatttcacaaggaaagtaaaaaccaccacagtctgaaatttaaaaattactgagttcagaatgaaattcatcataaattacaaatacactgaacatcagtatgacatagatcttaaaatgagaacaaatatgttaattttagatatcaattattaaataaaattagttttaagaatagtaaaaaaaaaaa

SEQ ID NO: 1359 - DNA, 434 bp, dog
tttttttttttagcttggatttcttttaaaaagcctattatttacctcaaaagagatgatagagaaaacctttgatatagtgccagttacataatataatatggtatgttttgtcctatacagtggatgcagaggtgatttactgctaattgctttgtgtttcttgtaaacccattttgtgtttatatagatattttcagaataattatctgacctactttctaaaagaaaacttacctttaagaaaaaatgttttttgactgattactacaagggaaagattaaatattttcattcaaagacaagctagtaagtttatcatgaactgaaaatccccgcctctgtctttccagtgatatttatttgatccttttacattttgttctcattatattgtccttaataaataaaatgtgtatctgtaaaaaaaaaaa

SEQ ID NO: 1360 - DNA, 370 bp, dog
tttttttttttagcactaagaggtggcctcttcactttagatctatataaaaaaagtggtaaatatcttttccttttgtgcagttgaacccatcctacattcaaattctctcaagcactaatagaaaaatacttatttggttgaggaagatttaaggcaagttctggccctttcaaaggcactgtgagactaaacccccaccccattattgctacatgtctttatacgcagagtatgtcacagtagaattggtggaataaacaaaagaccttttttttttgctaatttaaaaagttggaatgagaaaagcatgccacattgaagcctgattcctgagcactttttatattctcatttttaaaaaaaaaaa

SEQ ID NO: 1361 - DNA, 369 bp, dog
tttttttttttaaaaatgagaatataaaaagtgctcaggaatcaggcttcaatgtggcatgcttttctcattccaactttttaaattagcaaaaaaaaaggtcttttgtttattccaccaattctactgtgacatactctgcgtataaagacatgtagcaataatggggtgggggtttagtctcacagtgcctttggaagggccagaacttgccttaaatcttcctcaaccaaataagtatttttctattagtgcttgagagaatttgaatgtaggatgggttcaactgcacaaaaggaaaagatatttaccactttttttatatagatctaaagtgaagaggccacctcttagtgctaaaaaaaaaaa

SEQ ID NO: 1362 - DNA, 516 bp, dog
  misc_feature (44)..(44): n is a, c, g, or t
tttttttttttagaactataaaaatactactttggagaactccnacattacagaaatgtgacttcagaaatccaaagttactgcccataatcccactccacaaaattactataataactataaaatgtttattagttcagaatatttttcctatgaaaagactaatatatataaatgcctttaaaatacacaaattgcgtcatgccacatgtcccattcttcatctgtatgtttatctggctggtgtgcagtgatgtctgttacaaagatgttcactgaaaacctagttgggttttgtttttgtttttgtttttgttttttaagctagttttagggatgcctgggtggctcagtggttgagtgtccgcttttagctcaggacatgatcccagggtcctgggatcaagttccacctcaggctcctcaccaggagcctgcttctccctctgcctatgtctctgcttctgtgtgtctctcatgaataaataaataaaatcctttatttaaaaaaaaaaa

SEQ ID NO: 1363 - DNA, 367 bp, dog
tttttttttttataataaaagcaatactatattgtaaccaagtacagttgatcttaaaaatacaagaatcgcctaacattccaaaagcaatcaatgtaatctacctattaataagcacaaaataggagatcctgggtggctcagtggttgagcgtctatctttggctcaggtcataatcccagggtcctcgcagggagcctgcttctccctctgcctgtgtctctgcctatctctctgtgtctctcatgaataagtaaataaaaatcttttttaaaaaaagcacaaaattaaactatatgatcatcctagtgaataagaaaaatcttctgacaaaattcaaaatccattaataattaaaaaaaaaaa

SEQ ID NO: 1364 - DNA, 317 bp, dog
tttttttttttacaaaatccccctcttacacctgattgtctcgactttctatcaagaataggacaatctctgtacaacaccacacttcaccagaattcaacagaaagaatctaaataatatagtcatataacctcaacttcatagatgcatatttcagccatcaaggatgatttgagaagactcctttgaatcaattctgagtgctaaattcagaacctctaggaaaggcctacatctaagttcaggaaatgcataaaacaattaaagactcaatgaaacaggaaatatgacagtaagtataccttaaaaaaaaaaa

SEQ ID NO: 1365 - DNA, 254 bp, dog
cctgcaatgagcctgcttctctctctgcctatgtctctgcctctctctctctgtatctctcatgaataaataactaaaatcttttttaaaaagtgataaatgaattcagcaaagttgcagcatacaaacttaacacaaagaaattagttgcatggggagcctgggtgcctcactcaattaagtatcttacttgagctcaggtcttgatttcagggtcatgagtttaagccctgcgttggcatgaagcctacttt

SEQ ID NO: 1366 - DNA, 43 bp, dog
ctgctggtacgagaggccttcctctttctgttaaaaaaaaaaa

SEQ ID NO: 1367 - DNA, 324 bp, dog
acgatgcacatctgaaacgaatacaagattatgtcatttacatctcaataaaaaaaaaaagctaagcttacgatgctagtatttaattggattggagagatgaaaggaaaagcgttatatatttagaaccacgttggcattgggatgagctccctccaggcatgtgtggacctgggattagccttagattgaccactaggacacaatccagagtcatttttcaaacattgcttttaaatatcatggtctgcaaatgtgataccagataaccagatattacaattaccatttgagccattttcacacttttgagtaaaaaaaaaa

SEQ ID NO: 1368 - DNA, 366 bp, dog
ctcctgccccagggcagggcctttcaggccagtcggaggtctcgcagatccacagctctggcccttacaggtgggcaaccccagcaaaggggcagcagaatattccctgcctcagtgttagtagggggcggggagagcgagttccggaggagggaaccctcacctctggctgcccctgaagtgcccggagaacctgggcttcctgcgcatcattttgtattgccgccttttgcattaaaaggaaaatccactgctaaaaaaaaaaagcttagctttttttttttaagtgaatgagttaagagatatatgctcctttgcaaatcttagttgctattattcaaaagacaatgtggaagagtgctggga

SEQ ID NO: 1369 - DNA, 186 bp, dog
tttttttttttacatgtgattggtaatcattttattttattttaattcaatttgccagcatagtataatacccagtgctcatctcatcatgtgccctcctcagtgtccatcacccagttaccccgtaagctttgcaattataaaattatatgcaagggtgaaagaaacaggctttaaaaaaaaaaa

SEQ ID NO: 1370 - DNA, 552 bp, dog
tttttttttttacaaacaaggtattaaactcattgtttcaacagatccatgcctttcgaacactgaatgaatcatctcgacattcatttttcttttgtgcaatttttgagaacattacctgtactcctcaaagtgagtgcttcaaaattcttcttcttcagcttctcaaattaggtgtacgttaaaaaaaaaagagagagagagagagagaaagaaagaaagttcccacaaggtatggtgctacaagaaaagatcctatcccgtaaggtaacatatttgaagcgaggtcatctatgtaaaagaaatctcagctccggagtggaggtgtgcaaattctttggagtttccctatcaacagaaacacaacactgtccgtggaaaaaagaggaaaccaacccaacacaatagcatacgcacttatgtgctttataaaaaagtatattttctgtatatttattacttgatgtgttcctaaattctctatttcagaaattctgggttaaaaacacaaaggtggaagcaaaggcttccactccactttaaaaaaaaaaa

SEQ ID NO: 1371 - DNA, 125 bp, dog
tctctgggatgtcaaatataatttttgtttctttcagagataagtaacacctgctctacgattcacaattaccgttaacctaattttgtcattaaatattttaactctgtgatgaaaaaaaaaaa

SEQ ID NO: 1372 - DNA, 83 bp, dog
  misc_feature (9)..(9): n is a, c, g, or t
ttgatcccnccagtttcagataaaagactatggaccttactataccttctcctctctctaaaatgtcacctgaaaaaaaaaaa

SEQ ID NO: 1373 - DNA, 38 bp, dog
gtacgtacgtacgcgtacgtacggtacgtacgtacgta

SEQ ID NO: 1374 - DNA, 43 bp, dog
ttattcgtataataaaggttgaaggaatggggaaaaaaaaaaa

SEQ ID NO: 1375 - DNA, 26 bp, dog
cgtacgtacgtacgtacgtacgtacg

SEQ ID NO: 1376 - DNA, 396 bp, dog
  misc_feature (164)..(164): n is a, c, g, or t
gttatagagagacgcaatttttgtattttttccctttttttctaaataccatgatatttgtctaatatgccttagtagcttaatggttatttagttattctttaaaaaaaaaaaaaaaaaactctttacatttaaccaagaaaaaaaaaaaatctgatttcccnttatatttcatggaccctgccatatggccgagtaagaaagatttttttttaaaaagtcactttcctcaatattttaccctctaggatgaagacatcagaaagcataccatgaaaatacaagacagtaaatacaacaataaagatgccacacaatactatggtaaagcagaatgagaagtcaaaagctggttgggatgtgatggtaaaacatgtgttcctagaaaaaaaaaaa

SEQ ID NO: 1377 - DNA, 342 bp, dog
gttataggatatttattttcttctagaaagctctaggtttttctctaggtttttctttctgggccccactcatgtcatttcttccatccagaatgtccatatctccaatgtcatctataaggctcagctcaaagatgaccccctgcacagagttatcccagattcccacagctacaagtgatctctctcttccttgtaccatttttacccctctcaaatagtggttacccatactctgtccttgcattgtaattattgcagagcacgcccttttccttatggaatataaaagccttcactatagagaatctgcctgtatgagtttgctagggttgctataac

SEQ ID NO: 1378 - DNA, 454 bp, dog
tcatatgactaatgcaggaaaggagtatgaaggtaaatataaggaaactagctggatgactaatttctctggatggcgggaggtggaggtggtgaagataaagtgggacaagggaagcaagagatgacagagatatttaaggaggtgaaatccatgggattaggtaatcaattgggtaaggggtagagaaagaatgctagagtgccttctagtctctagctaaatagaatgaaaggcgatgcctttcatagagacaaaaaaaagagaggatcaggttgaaggggcagagagcagaagagtgtgtgacaggtgtgacactttgaatttgagatatctttgaaatatccaaggggagttgtcaagtaggaactgaatatgtaaatctggagatcagaggggaggttgggactagaagtataaattcatgaatcatctgtcaaaggatggcatatga

SEQ ID NO: 1379 - DNA, 40 bp, dog
ccagtgctaataaatgagcagtctacgtgaaaaaaaaaaa

SEQ ID NO: 1380 - DNA, 39 bp, dog
ccagtgctaataaatgagcagtctacgtgaaaaaaaaaa

SEQ ID NO: 1381 - DNA, 174 bp, dog
acggggttgctgtgagaatcaaatatgacactgcatatgagatgttgagaaaactgaaaagtgctatacagattagggataaacaagtattagatgttcaggaaaacctatgttgctccttcatgaattctgtcctcaatacaccatctgtgtgattgtttatttcccttagag

SEQ ID NO: 1382 - DNA, 249 bp, dog
ggctgacctatagtggggaaaaaaaaaaagctttctttttttccacatggagatatcctgaaaatgcactaccgtaaagaaaggcagtaccatcatacagtcattaaaaagaaataaatacaaagcaaactaattaaataatcaggcaattaaaagatccaggcagactaggatatgactttccatttcattcataggttgaaagaagtgctgttggaatagtaattctttcatctcctgcagtcagcc

SEQ ID NO: 1383 - DNA, 56 bp, dog
ccattatactttctaagccatatcactagttcctaaaatacatggaaaaaaaaaaa

SEQ ID NO: 1384 - DNA, 23 bp, dog
gcggtgagaaaggaaaaaaaaaa

SEQ ID NO: 1385 - DNA, 27 bp, dog
ggctgacgggtatattaaaaaaaaaaa

SEQ ID NO: 1386 - DNA, 27 bp, dog
ggctgacgggtatattaaaaaaaaaaa

SEQ ID NO: 1387 - DNA, 80 bp, dog
ggctgacccacagatgtattttgttggttttcacagtgcttttggaaaacctaagttagtttccaggttaaaaaaaaaaa

SEQ ID NO: 1388 - DNA, 101 bp, dog
aactgagcaggattgagctgctttcactggattgtgtctgccacaattattcctagtgaataaatgtttttatatgtttttattcttcctaaaaaaaaaaa

SEQ ID NO: 1389 - DNA, 89 bp, dog
aactgagcaggattgagctgctttcactggattgtgtctgccgcaattattcctagtgaataaatgtttttatatgttaaaaaaaaaaa

SEQ ID NO: 1390 - DNA, 36 bp, dog
gcctttagagatgttcctttaatttaaatgatgtgt

SEQ ID NO: 1391 - DNA, 43 bp, dog
gcctttaacattcctgccttctccaactaaataaaaaaaaaaa

SEQ ID NO: 1392 - DNA, 336 bp, dog
cagggcacattggtaaaatgagaaaatctttatttttttgatgtagccgcaaaatcgggtagtgggggaggaggaggaggaatgtgctttcaaatgactgatttcagcttctaaaacggactttgcctccaactttgaattgtgaaacaagccataaagcaattacagtgatttctgggatttttaggagacagctgaaataaaagctactccgcttggggctggccaggaggatcatcacacaaaaaacccacagtctgtccactgattggacagtgcccttttgtgtgtggtgtgcgagttgccgtcatccatggcatcttcttttctgccctg

SEQ ID NO: 1393 - DNA, 24 bp, dog
gcctttatcaattaaaaaaaaaaa

SEQ ID NO: 1394 - DNA, 552 bp, dog
ttttttttttaaagtggagtggaagcctttgcttccacctttgtgtttttaacccagaatttctgaaatagagaatttaggaacacatcaagtaataaatatacagaaaatatacttttttataaagcacataagtgcgtatgctattgtgttgggttggtttcctcttttttccacggacagtgttgtgtttctgttgatagggaaactccaaagaatttgcacacctccactccggagctgagatttcttttacatagatgacctcgcttcaaatatgttaccttacgggataggatcttttcttgtagcactataccttgtgggaactttctttctttctctctctctctctctcttttttttttaacgtacacctaatttgagaagctgaagaagaaaaaattttgaagcactcactttgaggagtacaggtaatgttctcaaaaattgcacaaaagaaaaatgaatgtcgagatgattcattcagtgttcgaaagacatggatctgttgaaacaatgagtttaataccttgtttgtaaaaaaaaaaa

SEQ ID NO: 1395 - DNA, 89 bp, dog
ttattcgatgaccccagtcaagtgactcttaaatttagaactatttttccttttactacccatttaatacgttttcttaaaaaaaaaaa

SEQ ID NO: 1396 - DNA, 553 bp, dog
tttttttttttacaaacaaggtattaaactcattgtttcaacagatccatgtctttcgaacactgaatgaatcatctcgacattcatttttcttttgtgcaatttttgagaacattacctgtactcctcaaagtgagtgcttcaaaattttttcttcttcagcttctcaaattaggtgtacgttaaaaaaaaaagagagagagagagagagaaagaaagaaagttcccacaaggtatagtgctacaagaaaagatcctatcccgtaaggtaacatatttgaagcgaggtcatctatgtaaaagaaatctcagctccggagtggaggtgtgcaaattctttggagtttccctatcaacagaaacacaacactgtctgtggaaaaaagaggaaaccaacccaacacaatagcatacgcacttatgtgctttataaaaaagtatattttctgtatatttattacttgatgtgttcctaaattctctatttcagaaattctgggttaaaaacacaaaggtggaagcaaaggcttccactccactttaaaaaaaaaaa

SEQ ID NO: 1397 - DNA, 26 bp, dog
gtctaaacctgacctaaaaaaaaaaa

SEQ ID NO: 1398 - DNA, 299 bp, dog
tttttttttttattttgaaaaatgttaaaatttattaatagttaacctcacatagttaattcaactagttctttattatacatgacaacaactttactagactgagtgctcaaagatttgagattcaacacttcccagtcaaagattgagatttactgtatttacatcaggcaaagcagcatcagcaaggaactgtcacctaaccatggggacacagacattcaaaatgcattttcctttttggaaaccaatgacataactaatagccatacatacagctctacctttaaaaaaaaaaa

SEQ ID NO: 1399 - DNA, 60 bp, dog
ctatttccacatcgatagacataaacaaatctctcctgccccgtgtcttaaaaaaaaaaa

SEQ ID NO: 1400 - DNA, 143 bp, dog
caaaattgtattgtagaaagttcagaacacttgtgaagaaaaatgaagagcagaaacatataatcctgccacttaaagcaccagttttcaaaattttaagctgctcttcacagacagaaatagatactgcattatgaccccgt

SEQ ID NO: 1401 - DNA, 374 bp, dog
cctctatacagggcagacacccaagatgcatttggtaaattgacccttaaggaaagtgtggaacaagccaggagtgactgtatgtggtcttgggaagagtgttgtgagcatagggaagagaaataaaaaccttgcagcagagtattcttggcctagataaggaggagcaaagaggccaaggtagctgggcagagtaaacaagacaaagtcctggaggatgaagccctagtggtagtagagtgcctagatcatggagagctgtcagccttagtaagcactttgccttgttctctgtgaaagaagccatcagaggcttttgagcagagaagtgaaatggtctgacatatgttaagggatgatcctgcattcatcca

SEQ ID NO: 1402 - DNA, 193 bp, dog
caagacccagagtgattacataggatctgttttaatttaatcactgatttaacctataagcaagcttaatgtcatgggttcattagtgagagtgaagtactctctaaaaataatgtcttctttcttcattaggatccccatgatgttgtccaaggtaaagaaaggcaactgttattttatttcaattgatgct

SEQ ID NO: 1403 - DNA, 616 bp, dog
tttttttttttgtaagaaaaaaatatgtctatagttgtattgcttgatccagtgagagaaaggcttaagagaccattttccaattcaagtgtgttacattttctgtatgcacaactaaagaaaggctttctaaatgcatccatctttcagaagaagataaaggtggcaaaatggctgcagcagattctgtgcagcagagacgtcagtacagacgacagaaccagcagtcttcatctggtatggacgtgggttcaactgtttcctacctatatttcctaatgaaaaataacttcagatacaaatctccatccatgtagtgagtgtacttaggaaaaatatatgcctacatagaaatctgttcaaaaggaggaagttcctacttttggtttttgtttttaagtcctttcttaactttcttttaaattgttataaacgtagtagatctttacagtacgacagtaaaacagaacaggggtattaaatttgaaaaattctaattcttttcccaatccctagtcttattcccaaaagcttttcttcagaaattttctgtgctgtgtatagggatctatggttttaaaaaggccaccaaaccctcccccccaaaaaaaaaaaa

SEQ ID NO: 1404 - DNA, 616 bp, dog
tttttttttttgtaagaaaaaaatatgtctatagttgtattgcttgatccagtgagagaaaggcttaagagaccattttccaattcaagtgtgttacattttctgtatgcacaactaaagaaaggctttctaaatgcatccatctttcagaagaagataaaggtggcaaaatggctgcagcagattctgtgcagcagagacgtcagtacagacgacagaaccagcagtcttcatctggtatggacgtgggttcaactgtttcctacctatatttcctaatgaaaaataacttcagatacaaatctccatccatgtagtgagtgtacttaggaaaaatatatgcctacatagaaatctgttcaaagggaggaagttcctacttttggtttttgtttttaagtcctttcttaactttcttttaaattgttataaacgtagtagatctttacagtacgacagtaaaacagaacaggggtattaaatttgaaaaattctaattcttttcccaatccctagtcttattcccaaaagcttttcttcccaaattttctgtgctgtgtatagggatctatggttttaaaaaggccaccaaaccctccccccccaaaaaaaaaaa

SEQ ID NO: 1405 - DNA, 53 bp, dog
ttaccgcatatgactaggaagcaggtttttgttacctcaactaaaaaaaaaaa

SEQ ID NO: 1406 - DNA, 167 bp, dog
cgactgtatcctctaagtgttggaaagtattcaagggagagacatggtaataattatgttctaattggatcattctggtaggtgtacagagaggataggttttggagaatggtggcctgcagtggtccagatgagagatgatgaaagcctgaatgagggcatcatta

SEQ ID NO: 1407 - DNA, 34 bp, dog
cgactgttggattatttgaaggtaaaaaaaaaaa

SEQ ID NO: 1408 - DNA, 86 bp, dog
cgactgtacattgaatcttctcattggagtatggctctctaggcatagtagagctgcagatactccatgcttggtaaaaaaaaaaa

SEQ ID NO: 1409 - DNA, 53 bp, dog
cgactgtcataaataaataaaaaatttaaaaaaaaatttcttaaaaaaaaaaa

SEQ ID NO: 1410 - DNA, 75 bp, dog
ctcaacggcctatctttactcttgtcaaatcttcccttttaaataaatggcataaccagttgctaaaaaaaaaaa

SEQ ID NO: 1411 - DNA, 93 bp, dog
ctcaacgtataattaaaccctgcaaaatatttcctcttaggaaatacgaaatgtgtctcttagaaagtaatagaaataagctaaaaaaaaaaa

SEQ ID NO: 1412 - DNA, 66 bp, dog
ctcaacgtgctaaattgaagctccttaaaataatctttggcaaaaataaaacagtaaaaaaaaaaa

SEQ ID NO: 1413 - DNA, 66 bp, dog
ctcaacgtgctaaattgaggctccttaaaataatctttggcaaaaataaaacagtaaaaaaaaaaa

SEQ ID NO: 1414 - DNA, 54 bp, dog
ctcaacgtggtactgagatcctgtttttaaaaagttatgaactaaaaaaaaaaa

SEQ ID NO: 1415 - DNA, 34 bp, dog
ctcaacgtaccccttttctccttaaaaaaaaaaa

SEQ ID NO: 1416 - DNA, 313 bp, dog
aacgaggacacggtatgcaagccctgcctcctaggctacttctccgatgtcttttcttccactgagaaatgcaaaccctggaccaactgtagcattcttggagagaaggaagtacgtcatgggactgataaatcagatgtggtttgtagttcttctctgccatctacaaagccaccaaaagaaccccagatttacttgcccagtttaattattctgcttctcttcatatccgtggcattagttgctgctgtcatctttggtgtttattataggaaaaaaaaaaagcttaagcttaacgagggaaaaaaaaaaa

SEQ ID NO: 1417 - DNA, 37 bp, dog
cattccgtatacaaaaaagttaaggtaaaaaaaaaaa

SEQ ID NO: 1418 - DNA, 18 bp, dog
gagtgctaaaaaaaaaaa

SEQ ID NO: 1419 - DNA, 487 bp, dog
caagtttggagagaagctgacttaaaggatgaagaaggaaagcatggcaaagatcaagaaagagcctctcctagattataacacctgcaatatccctgtagaaactttctcttctgaggccttagtatttcccaaggaattgtgtagttagggaaatgaaccaaaaaaaaaaaaaaaaaatgagataaagcaattaacatcaagacacaaagtgttcaatatataaaatttagtgataaagagaagttcagcaggtgacagaaaaagcaatttacctgtgtggatgaaaacagtggctgaactcatacttttctattgccaaaagcaatgtctacaaaattcttaggaaacaaaatttgaatcaagattttgataattgaattgctattcagatattaatttgaaagagcttgaggaataaaacttccataattatatttgagaatatcatttagtgatgaaatccagcaaactggaaaaaaaaaaa

SEQ ID NO: 1420 - DNA, 95 bp, dog
cgggtaaaactgaaactaaggccgacactaaagctgaaagcaaatctgaaactaaagaagaaagcaagtcagagactaagacagaaaaaaaaaaa

SEQ ID NO: 1421 - DNA, 66 bp, dog
cgggtaattaaaagaaaagcaatagagaaaaatatactctgctaacagtaaatggaaaaaaaaaaa

SEQ ID NO: 1422 - DNA, 652 bp, dog
tttttttttttaattggagttcaatttacaagaatggattttaattaagattaaaactatgtagttatatacaggtaaatcatgtatgttggtaattacacatcttagtaactttcacctttaaaaagttttcaaaagttttattttattttaccaactatggagagaaatgaatatttaaaccagtccctaaaaaagtaaaataaatttaacaaagaattacaatgcttccatacttttttctttttctacttccataactttcttcttccattcatcaaatgttggtatatcttctgggtctttgggacttgttacagatgtgtggtcaatttcccctggttttgtgtaatcagaactctgaaagaaatacaaaagaatacagagaaaacagattaataaattgtaaaagtacatacaaatgttcctgtaaaattaaagtcaaattttatagttgacagaaaatatctcagaataatgaaatgtaaaaagttttggtttgcttaaaaggcgagtttcccttgaaataattgaaaatcttctacctaagcatcacaagatgtattcttgtggaaatctacctaagcatcacaagcaccataggatgtattccttcacgttagcaatataagcataggttgtaaaaaaaaaa

SEQ ID NO: 1423 - DNA, 532 bp, dog
tttttttttttaattggtttttgtttcttactgttggccaactcttaaatccccagcaaatcactgggccattggattttttccattatgttcattacccttgtaccgtgtacctcagatctctttctctctcagttacagtttctcgtcttggacttcttttattattattataatttttttttgctttaaaatgagtgtgatgccatatcgagtcaatgttattctctcacagtgtactctataagaggtgtgggtgtttatttggtcgggatgctagcaagtgctaaagtagcatgatcggtataagcaaaaggtttttaggaagtatggaaaaatgttttattggttatgatggtgacatggtatagtcagctgccttttaagaggtcctgtctgttcagtgttaagtgatttttaaaaataatggcctgttattctgaccagcttaaagatggatttgcaaatggttttggatgcaattaggttatgctatttggacaataaactcaccttgacctaaaaaaaaaaa

SEQ ID NO: 1424 - DNA, 263 bp, dog
tttttttttttactgatatactatagttaatgtcatacaagttaatgtaactgcttctttccttctactgataattcttttcttcagtatattttttgttcactactccccttcttaccaaatgcctgattctatcttcctcattttactcaagtgatctgaaatgttacattacttgcaaatgttttataagcattacaataaaatgaattttagatttagattatcccattaattggtgctttcctttttaaaaaaaaaaa

SEQ ID NO: 1425 - DNA, 889 bp, dog; identical to SEQ ID NO: 1348

SEQ ID NO: 1426 - DNA, 541 bp, dog
tttttttttttagaaggcaattagggccacctgggtggctcagtcagtcgagtgtctgccttcagctcaggttgtgatcctggggtcctggatggagctccacatccggctccttgcttagtggagagtctgcttctcctcactgtctctgcctttctcttcactcgtgctctctgtcaaataaataattttttttaaaaaaaagaagaaaacaattaactcaacttccttaacatagatatgttgagaaaaagaacttaacagttcctagtaaaaagaagaaaaaggaaaagagaaaaagaaaggcttaagggttgttttgtagaggctttctccttggttttgtctggccataaaatcaacatggtctaaatgggaagagactaatacaagtactgatgaaatctcgtcttcattaagataagcagagtccagaccgccccccacccccccaaaaaaagaactcactgcatatggcaccattctgattcaactaaatcactttatccagtattggccaaacttacaataaaaaaaaaaa

SEQ ID NO: 1427 - DNA, 605 bp, dog
accaggtgccccttatgtagatcttcttaaatcttttgtcagtaatttgtaattatcagcatatggatcctatatatgttccggttagatttatacctaagtctttcaatctttctttctttctttctttctttctttctttctttctttctttctttctttctttctttctttcttctttcttatttacttttcttttcttttcttcgtttcttttctttctctctttctttcttggaggttattgtgttaaattccagtttctaattttatattgctttttattgcttgtatatagtaataagattgatttttgtgtgttatcctgtgctgatgttgtaattgttttagaatagtctgggattttctatgtacataatcatatagtctgtgtatgtctgtttccaatctatattatttttatttctttttcttgccttttgccctggccaggatttccaacttggaataagcctggtgagagaggacatttttaccttgtttccaatattagggggagagcattcagcatttcaccattaagtattacacaagtacataattctacacactaacctcataggactgtacactaaaaaaaaaaa

SEQ ID NO: 1428 - DNA, 403 bp, dog
agaggcatcagagagaatggaacattctagaaacagaaagctgtcagtgctagaggaggaggcaaaggaggaagatgggctcaggaaacgagcaagaggacgatcccagagggcttctcccatccagagtgagaagcttggattttgtccccagtgagatgggagtgttcaatatttgcttttttgtgtgttatttgggttatgattgattgattgattgattttttaagtaggctccacactgggtgtggagcccaatgcgggtcttgatctcagggtcgtgggatcgagccctgcatcaggctctgcactgaatgtggagcccacttgagattctctctctccccctccccctgcccactccccaagtagcatgtgccctcgctctctcttaaaaaaaaaa

SEQ ID NO: 1429 - DNA, 302 bp, dog
agaggcagaaacaggcagagggagaagcaggctccctgcaggaagcccaatgcgagattcgatcccaggaccctgtgatcatgacctcagccaaaggcagatgctaaagcactgagccacccgggtgcccaaaaaaggctttaattgcttactcatttattacttatccataaaagtctctatagaagccaaactacttaccaactcaagctaagtctcttttgtaagtactgttttgcataactgaaaagcataatatagtctgtcagttttatagtcccattacctcctaaaaaaaaaaa

SEQ ID NO: 1430 - DNA, 732 bp, dog
tttttttttttaaattagtcttagaaaaataaaaagttatacaaagagtaattaagactaaatatgtgaatgaccagtctccaaataaactccattacttccaatactaactcctccaaaaacaaattatttcaagaatgaatataaccaaaattgaaaagttacaattcctcaaaatatttagtaatataaaacaaaaatgtgtaccacattccttactatattcagtgttaacaaaatgtactaccctaattcctttctttctacccttcccccaaattactagatcttaaattattaacgatttaaatgaaaactttcttctttatgataagaatgattttttaaaactgaatcaacggagagtcagcatttattatatcctagagggaatgcaggatttgaagtcttatttaatttataaataagcacattatgtgaaaatttctcctgcaaaagaattatggagtatccaatgtaaaacggttctcaaaaacctttaaaacagaaaaattactcctcaaaacttcaaaaagtggttcaatttcacaaggaaagtaaaaaccaccacagtctgaaatttaaaaattactgagttcagaatgaaattcatcataaattacaaatacactgaacatcagtatgacatagatcttaaaatgagaacaaatatgttaattttagatatcaattattaaataaaattagttttaagaatagtaaaaaaaaaaa

SEQ ID NO: 1431 - DNA, 312 bp, dog; identical to SEQ ID NO: 248

SEQ ID NO: 1432 - DNA, 260 bp, dog
gttgtgctcaaaataatgcaagaggaaatgagttataggaagcagaatcaagaagccttaaggataaaactgactgagttaagatggaaagggggctggcagcttaagagtggcataataaaaatccacattggaggtagtcccaattggatttgattacagaaaatcaaatcaatggtatagagggtaaatttgagaaatgtatccaaaatgcacagaaaagagagattacaaactaagataacatgtaaaaaaaaaaa

SEQ ID NO: 1433 - DNA, 354 bp, dog
cactagcatgtataagaggactttaatcacttatatttactcatcattttggcatattattctttaatcagggcttctgaccacaggacccagggtgtgctgtgaaatgtgtcccttcagaaaattaaaaagaaaacttgcctaaaaggaatgtcatgccatgatcattcattcctcaatcagcacacaccagagtttcctttacaatggtcaataaatagaatggttaaattactttctgaaggccatatatccatttgggggaatgtagcaattgcctctcagattgtccaagaactctgataataaaaagtaactatagaagcaacttgtagtcctcattaaaaaaaaaaa

SEQ ID NO: 1434 - DNA, 336 bp, dog
cactagcacattagaaagatagctgtccatcagcctcagaataggcaagctgaagaggctgaatattgtgtatcaatccctctccaaatttttatgacatcatttgcttaacaaatcttgagacagaagatattctaggggatccctgggtggctcagcagtttagcgcctgcctttggcccagggtgccatcctggagtcctgggatcgagtcccgcgtcaggcaccctgcatggagcctgcttctctccctctgcctgtgtctctgcctctctctctctctgtctctctctctcaagaataaataaataaataaataagtcttaaaaaaaaaaa

SEQ ID NO: 1435 - DNA, 209 bp, dog
cactagcaatgtgtctgattttgtttttgtttttgttttgttttagtttcagaggtagaattcagtgattcatcagttgcatatgacacccagtgctcattatgtcacgtgccctccttaatgcccatcacccagttaccccatcccccatccacttctcctccagcaaccctgtttgtttctatgattaagagcctcttaaaaaaaaa

SEQ ID NO: 1436 - DNA, 235 bp, dog
ggtgaaccgctgacatggcagtcacgggactggcctccccactgagcacagggaagattctggaccagaaaacatatagctgcgctaataggctaattgttctgtgtattgaaaacagtttcatgacagatgctaggaagtaatgaccttccaatgattcctaagagttttccagtttttcttatgtgaagagttgacactgaaatctaaaatgtttaaatgttaaaaaaaaaaa

SEQ ID NO: 1437 - DNA, 312 bp, dog
gctgctctaatacccggctaatcggaggtctgtgaggagcttgggaattggtcagagtctattcatctttgcttgttttagctccatgtctggacactctggggaccgctctgttcagtgccccctacatttagacatttgattcccccaggagatctttcctatgtcagaggatttgtctgtgtggatatcatgtttggaccaacatatatgcctctacccaattttaattatgtagtaaagttgatctttattagagttttatttcaaacatagatctcaccactcctacttctgctttaaaaaaaaaaa

SEQ ID NO: 1438 - DNA, 711 bp, dog
agaggcaaccaagaagcccttctgtaggtgaatgggcatccaagacaatggaatattcagtgctaaaaaataatgagctatcaaggcatgaggagacacagagaaaacttaaatgcatattactaagtgaaagaaaccaatcggaaaaggctacatatgatgtgattccaactatacaaaaatctggaaaaggcaaaattatggagacagtaaaaagatatgtggttgtcagagttggggggagatgggggagagaggaatggatggagcacagaagactttcaaggcaaggaaaatactctgcatgatgttatgatgatggggtcacgttatatacacttgtccaaacccatagaatgtacgacaccaagaatgaatccaaggtaaataatgggctttgggtgatcatgacgtgtcaatgtagggtggtcagcgtaatgaatgtgcatctagtgagcgatgttaatgacgggggaggctaggcggtgggggtacacagggaatccgtgccttcctctcagttttactgcaaacctaaaacttctctgaaaaatacaaaaatctttaaaaaaattataggcacatattaagtcaacgtgaatgcaaatgtattagtaaccaccttaaatatagaggaattaaacatgccaacgtaaaaactaagattttcaaactgagaatgaaatcaaaggccaattggaaaaaaaaaaa

SEQ ID NO: 1439 - DNA, 310 bp, dog
ttttgatccactcaactcttttaaagcactttataaactttaatttaaaacaacattgttgaaaaaaaaaggagctcctctatgatgttcaccccaagcagaactcaataaaaattacaaaacagaggtttttatattagtaaacatgaacatgtaccactaatacttgagtaagaacaagctaaccacaaattgatggggtagaaaaaaagaaatcagattcccaactagtattttcctaccagaattctaaacaaatgagagaaaatcttctgctttacccaaaacaaattgatgtgaaaaaaaaaaa

SEQ ID NO: 1440 - DNA, 478 bp, dog
cactagcctgtgttaattccaaccctggattatcctgatgatctctttccaccattcctcttcctcaatttcctcaaaaatttcctccaaataccactaaattcatgtttttcaaatctcacctggaaccacagtcttgtatagaaatgctctcactcatcttgggtcagtccccctccccttccttcctcccataaaggtcacacccagctctgcctacactctcccttacacttcttagtaggtaacattcctccccgagttgacagaacagatgccgtccaataatttccctctactcttttactaaccttattaatgtctttacggtctttcagaagagatgttttcacttctattaagataattccttcccatgccctatagtctatctcctcccttctccagaatgtccctctattgtaccttctacccttgtctttcttctgtttctactatttagcctgaaaaaaaaaaa

SEQ ID NO: 1441 - DNA, 201 bp, dog
cactagcagattgtaccaaacatttgaagaagagttaatcctcaaactcttccaaaaaattgaggagggatcacttctaggatgattctatgaggccaacattaaccctgatattaagccagacaagagcctacaagaaaactaaatacccatcccatatctctggtgaaaatgaacatactcaacagtgaaaaaaaaaaa

SEQ ID NO: 1442 - DNA, 114 bp, dog
cactagcaagagaaagatgagtcaagagtaaattagtttcatctgcataacacagaccttttataaatttcattttccattcaaatacggaatatgctatgtggaaaaaaaaaa

SEQ ID NO: 1443 - DNA, 456 bp, dog
ctgctgggccctaaaaatgaataagggtcagatagaattgtaaatgtctaaaacaaatattggatagctgaattaatcagcaatatgctgtgcagttgaacttgaaagtgcaatttaggaatactgaatattaattaaagcatgttttaacgatgctataattttaacactttcagactactgcaatagagcatttcttcaaggatcctgaaatcattcttatgaagtcattcttaccaagaactgaatatttgaatgcattgggaaaatctggtgcataaattacctttatttgttgacctattccttgtcctttttacaggataggtatctagctttaagtcgggtgaatatataaccagtcttaaatactcttgctcacccccaccccttatcgttttacctagtgtgccttgggcctgtctcagcaaatatcaatcctttgaaaaaaaaaaa

SEQ ID NO: 1444 - DNA, 819 bp, dog
tgagactaatgctcaccaagttagtctttgtgttcgttttatttcagggtattggctgctgggggttcgccctcatgtggcctgaaggtgggcgaagggaagtagcaggcacgtgatgctggcaaggatgtttctggggctggggaactagtgggagaaagtcctgcagagcccagcagccagagccgcagatgacaaggcggtcactcacagccaggacctgagtctgtgttaggaaaacatattaattctcatataaacccagttcctcaccattttcctctcatctttcagtgccatttctcttcatgttaggctgtttgacaaacttttgggagccggggtggtacatcagttctctggaatccgccaggccgctggggggtggatcaccacaccctgtagggcttctcccctcctagctgtctttgggaaacgcaggactgggaggctgttttgaccagagaggccaaggtcaagagcaaggtgtagaaaaattgtaaaatagaaaaagtggtgttggtgaattggttttgttttgttttgttttgttttcacatttggatagctgtcacaagaggtctttccctcagtttccagcatgttcttccttttctccctttctcacgtttttcctcctattaatcaagagaaacttcaaagtccatgggatggtcggatctcacaggctgagaactcgttcacctccaagcatttcatgaaaaagctgcttcttattaatcgtgcaaactcttgccacgatgtggggagtttgacaaatctttcaaaataaaaagtaatgacttagaaaaaaaaaaa

SEQ ID NO: 1445 - DNA, 568 bp, dog
cgaaatgtcaatcgctttaaacttaaattacctctcaagagaccaaggtacatttacctcattgtgtatataatgtttaatatttgtcagagcatcctccaggtttgcagttttatttctataaagtatgagtgttatgttgctaaattactcaaatggtactgtattgtttatatttgtaccccaagtaacatcttctacactttgttttctgtattttattgtatttgtgcaaaattcttttggctttatcagtgtgatctctgccctttcagatgtgtacagaaaatgtccatataaattttcattttagttgaatgcctttgagaaacctgtaaagaggaaagaaacaaaaaactgcagttccccataagtttttaaaagttgtatattgtatttgtagtaatattctgaatgagttgtaaataggaagtagaagaacaatgcttatgtcaagtcctaacactacagtagaaaaatggaagcaatgcaaataaatgactttttttcccaaatgctagtggaataatttaaaataaagtgtgtatattggattgaaaaaaaaaaa

SEQ ID NO: 1446 - DNA, 194 bp, dog
cgaaatgccaaattcttatttttctacaaatcgggttacataaagtattggtatcatgagtagccagggaacagaattgggttcattggcaacactatccaacttcacattaaacttgtcaccatgagatagcattagctgcccaggatgctgctatttaaaaaaaaaaaaaaaaaaaaaaggaaaaaaaaaaa

SEQ ID NO: 1447 - DNA, 214 bp, dog
gacctttcaacaatggaagaggatagagagttagggggcctgacaccccatgcagtcaaaaatagtgtaacttttgactcctccaaaagttaaattagtaatagcctactcttcaccagtagtcttaccaataacaacggtcacttaatacatattttatatgttacatgtattatacattcttttacaataaagtaagctagaaaaaaaaaaa

SEQ ID NO: 1448 - DNA, 816 bp, dog
ctatttccattcatgacaaagtaacttgtactaatctagatctcctgctaaaaacaactacaaaactggacgaaatgcatgagacaacttgctctaggcatgcaaaaaaaatagtcagtggaggactacaggccccgagaagtcagcccagtcatgggtgtagctctctcccttgggtgtactttcttgccactgtccagggagctgagccaagtagagtggtgatctcggtgactgatttcaataccgactagtctcatacatattgaattggaatcccagagaaggaattgaaagaaagttgagtagaaaacatgtttgaagaagcaatggccaaaaaatcccccaaatttcaaggacacatcaattcacaaatccaagaagctggtcaataagaatatagatgcaggaggtctgaacatcatcagccacccgaacctcatgacgactcgcagaacgctcaatgattgcacagtgcacatccctttcaagtgctcatggtatattcacccagaccatcttctggaccttagtataaatctcaatcaggttaatatgactaaaactctacggcatatgtttccctacccgtgtaactaaattaggagtcaagggaacgttcatatattcgggaattagaagaaccaattccaaataaccaatggatcaaagaagtactcaccagagaaagcagacaatatgttaaactaagtgataatgaaaaacatcacacatcaaaatctatgagatgcagctacgttggtttttacagaaaaaaaattgtggattaaaatgctcacagtggaaaaaaaaaaa

SEQ ID NO: 1449 - DNA, 571 bp, dog
ctatttcattaacgttttttataaaactcaaaagagttcttatagttttgtgatgatccttagctaacaaaggaaatagctttattaaactgtaggatgatatttcacaacaaaggcttttaagaaagtgataagccaacctgtgagtctgccactaaagcaaaaatatctcaccctcatgaaaactaaaatagttttaagatttgtgttgctcttttggtttggcttagcactgaaaataactgagcattttttaaggatacttccttgttgctttcctttttttctagcaattgtcctaaccacaacctaagttcttcattttattttcaccttgaactaccaatgtttgtatcaaattttgaaatatcactccaggcatgcttttatttagttgaaggaaaaaaatgaagggaagcattataccaagtagatgaaccatttatacagaattaatttgggtgcataaaaagaaaacaggggcggctggctggttgtcagtagtggagcatgacacccttgttctcagggtcatgatattgagtccacattgcagattgaaaaaaaaaaa

SEQ ID NO: 1450 - DNA, 194 bp, dog
ctatttcataccctctcccactacaaactttccgtgcagttacctttcatttttaaagcaatttcactgctaaatataaattgtatttgtggggttcatagttatataatgctgaagggaaccactctttcgttgaaaggtgataaaagttaaataaagactgtctccacagtaagaaacgtgaaaaaaaaaaa

SEQ ID NO: 1451 - DNA, 239 bp, dog
ggtgaacatactatattgtgttataaatcatttcaggacaggaagtataattgttgagttttttggtttgggggttttattttgttttttcctttccacattttcttgtgtagcctttaaactattatttatgcccctggcacaaagaaagtttctcatgttgttcctttcaattggttccttcaattatttattgttctgacttccttatccctcattcatttcttgaaaaaaaaaaa

SEQ ID NO: 1452 - DNA, 405 bp, dog
tcatatgtgctctaaaaagataactctcctgtattaaatgttcacaccacgttggaaaggcacttgttcagtcatattttggagcaaagttttgagtctatgttttttatgtttgtatgaagtagagatatcagtgagtttgtctagaatcctgaatatggtgagtagtttaagatgtcaaatgctattctactgttagttcagcattgctactcactaagtttcaggattacaatgtattgtataggctttaaaaatttctttatgaagatttctagttttgaaaaaaagatttctagttgtggaaattgaatcaaaacagtaagacacctatcagaaacataaaattgacatgcttattgacaaaggaagaatgtcaataacaaagggttggaaaaaaaaaaa

SEQ ID NO: 1453 - DNA, 344 bp, dog
tcatatgggagatttatttcctgcttttagggcgacagaggaggatctatgaatgttgtttcccaagtagcttcaattcaaaataatcagtatgctgtggtggtacattttgggctgccctcgcctgaaccctttacaaaaccaatcacttgaaaagcacgcatccagaaattatccttgctaaatcatggacaaatatgacttcagatgtctctctttacaactataaggacagatgggtagaataataaatacaagtaattttattaaaatagaatcatgcaagtgctatttaaccaaaattgttgattttaatataacttcacttcattgaaaaaaaaaaa

SEQ ID NO: 1454 - DNA, 333 bp, dog
tcatatgtactaactttggagacaaaaaaagatattatagagttttgtaaaagttgtatgtgttaagtccagatttatacattaaaaaaaattaatggtaccacatcatttataaatcctcttaaaattatatttggaaacctttgggttataatctatgttaaaagtaagaaattactctctagtggctaacaggtctcatatatgatagaacttgtgatgtattgtggtctattatttcttctaagtataagttaatatggctaaaacacatttacaaaaacaaacatttacaagtaaagaatttggattatgtcattgggaaaaaaaaaa

SEQ ID NO: 1455 - DNA, 223 bp, dog
tcatatggagacattttgatttgctatagctactaatttatttggtactggaggaggtggaaaagagtaagatgattaatttactcaagcaagtccatccaaattagcttatgttttacaaatgtgcactttatttatttaatatttacttatatatttaatcactacttctaatgagatcaatagggagctttcttgttctctagttggtgaaaaaaaaaaa

SEQ ID NO: 1456 - DNA, 173 bp, dog
tcatatgcaaaaatcagaatgaagaagtaggaaaaattatttatgacctcatgttaactctttgaatatttcaagaatggataattgtttttatctgagactttaaaacaatttcttccttggagtgtataagaagtatactcttaagtaaatacacatttgaaaaaaaaaaa

SEQ ID NO: 1457 - DNA, 156 bp, dog
tcatatgacattacatatcattcatataatttcaaataaattttactaattcctgaccttcacttacttcaaaaactagttcagtaccaatctcttaaaatcatctctaataatctcatccaggcatatgtccttctactctttgaaaaaaaaaaa

SEQ ID NO: 1458 - DNA, 366 bp, dog
tcatatggaaggcatgttaggaaaacaatatccaaaatttgttcctttctgcttctaatatttattctttgtatagtgttttataaaagttcgatgtggaaggcgggtgaggttaaagacatctcttcaggccctgggacagcgtgttatggtaaaaagagctcaccctgagaacctaaaaaactcatttctagtcccctttttcctgggaaagtcaccctgccctctctgaatcagttttctcaactaccattgtgttgagccaggtgatttcaaatatctcttcctcctctgaaagtgttctttaacttttctctgtagagagttgattgaaagagccgcagatttcattatgaaaaaaaaaaa

SEQ ID NO: 1459 - DNA, 215 bp, dog
tcatatgcacccttctacacacaaaattaaattttgtatttggttttcagctaaatcagctctgtggctaccaaaaataagagattgttttagggttgccctggaagttcacagtgggagacttgagctgagggtttgagctgagctgttttttctctcagtaagtgctctagtgcactcaaaagaatcctccccccccccccgaaaaaaaaaaa

SEQ ID NO: 1460 - DNA, 197 bp, dog
tcatatgagcaatgttgaacctctccttgtaaatatatttttctctcctttaaattgccccacaagaatttcgtatcttctgttaaatttcttgaagaaaattactcaaaaacaagtttttccttctatgtgctaatcatttcaggtgtctgtattccttttgctgtcattaagagacttactgagaaaaaaaaaaa

SEQ ID NO: 1461 - DNA, 312 bp, dog
gtagtaatcaaacagtatgattctggcacaaaaacagaaacatagaccagtggaagagaatcaagagccaagaagtaaacccatacatgtatggtcagctaacatatgacaagggagccaagaacaatgcagaaaaaacagtctcttcaataaatggtgctgggacaattggatattcacatgtaaaataatgaaaatagaccctcaccttaagcaccactcacaaaaattaactggaaatggatcaaagaggagaaaactacatacaaattgctcactttgacattgtttacaataatggaaaaaaaaaaa

SEQ ID NO: 1462 - DNA, 234 bp, dog
gtagtaagagacaaatagcatagtttaactctttttgaaagggcacattttatgagccttcaattaatatatggaaataaatgaaggccacccaaatgagaaaagcaagggctatttattcagagcttggtatatatagcaagggagtcagccactgtccctttcaactttattttctcagagactcaaatgcaggcaagggagtgggcaagttttatagtagaaaaaaaaaaa

SEQ ID NO: 1463 - DNA, 220 bp, dog
gtagtaatggtatttactaactttttccacccagagcacattgcttaactataatactctgaacacactaggtgtcagatataagctgactgtatctacagaaactgagggcttatgtgtgggaaagaaaccgagagagaaggaaagctttaacagatggacctcttaaagatacttctgcatgataaaagcaataagacagaaaatggaaaaaaaaaaa

SEQ ID NO: 1464 - DNA, 180 bp, dog
gtagtaagcgaacagatctatgtgaccatgccctgcacatatcgcatgatgagctatgaaccactggagcggcccagactggcaggcttgatggatcacccccaggaggggaagagggtggcaatgccttttatattatgtttttactgaaatgaactgaaaaattgtgaaaaaaaaaaa

SEQ ID NO: 1465 - DNA, 567 bp, dog
gtagtaattacacaaaagaacatgataaagaagtaaggcatactgataccagcaaacattaaaacacacaaaaaaagatgacaggataagtatcaaggcacagtaaaattataaaacaaccaaaaaaccaaatgataatagtaaatccttgttatcaataaatactttaaacataaatagattcatttctctgatcaaagagaatggctgaatgaatttaaaagaaaagatcccataatatgctgcctacaataaacacttttaaagacacacatactgagagtgaagggatcgaaaaagattttaagcaaatgggaacaaaaaacaaaaagaaatcaacaaaggtaacaatattgacatcagacaaaatagactttaagctaacaatgataaaaaaagacaaagaatgtcatttatataatgataaaggggtcaatacataaagatacataacaattataaatatacatgcacccaatgccaaatgcttctaaatacataaagcaaaaccaacagagttaaaaggagaaaaaaacatcaatataataatagttggaaaaaaaaaaa

SEQ ID NO: 1466 - DNA, 416 bp, dog
gtagtaacccattttttttggtgtattaaaatgaaagatgctcccatttacatgttctgattctaatcatgaagtatttcagtaattaaaggacttttttcttttttataagggaaaatcatcatcacatcatttactattaattttatgagcaattttaataaatgaaatttttagacactttctccttgcgacattttgtacatcattatcctttatcctaaagcccatgcacatttctctttcttgaaaaactatctactggtggtcgttgttgtttttttctcatcagcttgagaagtagagatttatgactaaagcactgtaaagattggaatagacctgcttttgtccgagctttaccagaatgaaaatgctaacataggaaaaactgttttttctccgaaaaaaaaaaa

SEQ ID NO: 1467 - DNA, 363 bp, dog
gtagtaaagacagtgttgcagtattatgcaaactccattaatctgtgcatgtgcttaacaaatagacaggagcttgcatgaatattactaagaaactatatgtgtagtcatcaatacaagatagttaaaaaaaattgagagtatcaattttaattgtgaattttaattttaattatgaatttaatagagacaactgaaagtggggttgcaccttttattcacagtttgcccagattgggcatgaaaaattaaaaataaacctatgatatctgaatggtgttaaatgggccacctgccctgaatcacaagacaaattgaaatgagtattcattttctattctgtagaatgggggaaaaaaaaaa

SEQ ID NO: 1468 - DNA, 340 bp, dog
gtagtaaaatgcaagaggaaagagatagattgaaaaaaggagccaagtgtggatgatttgggaagttttcaatctctccagactgcaaaagatgctaaaattttcactgtcaggaaaacatgttctagaaaaatgctaaggttctgactctgcaacctcttgctaaaaatctcagatcaaataatcagagtatttagtcatgcaaaaggtgtttcaagaaattacaggtgtcccatatggaccctctccatctgactatatgctctctaggaagcttaaggccattgtcccttagccatatatgtaggagctggagaaaagattacctgaaaaaaaaaaa

SEQ ID NO: 1469 - DNA, 294 bp, dog
gtagtaaccccctctctcatggctgagatgattttttatccccccaaggcatggattcctttcctcacgtgactagaagacataggtagggctgagcttataattaatgaaaagatcctcagctaaattcaattgaacacttatgacattccggacattcttctcagcaaagaaaatgaattacctatttgatcttcacaacagcttcctgtaataagagctattattccccattttacggataatgaaactctgatacagagagattaagaaaattaattggaaaaaaaaaaa

SEQ ID NO: 1470 - DNA, 279 bp, dog
gtagtaatacaacttcaccatcactgaatattctatttattttattttattttattttattttattttattttttaagattttatttatttattcatgagagacacagagagaggcacagacacaggcagagagaggagaataggctccatgcagggagcccgatgccggactgatcctggaaccccgggatcacgccctgagctgaagacaggtgcccaaccactgagccacccaggcatcccaatattctatttttaaaattttggaaaaaaaaaaa

SEQ ID NO: 1471 - DNA, 249 bp, dog
gtagtaaccactgagaaaatttttaaaatacaaaaaatgattaataaaaggaatcaaaatattacactagaaggtattcagttgtggggcacctgggtgactcggttaggtgtcttttaatttcagcgcaggtcttgatttcagggtcatgagttcaagccctgtgttaggccccaactgggtgtaaagcctacatttaatttttttttaattagaaataaaacagttgaacaaagggaaaaaaaaaaa

SEQ ID NO: 1472 - DNA, 193 bp, dog
gtagtaaaaccaaagaaaaaacaggacaaaatgggaaattcagaataaaaactacaaccacagacgtggcaattatttaaagcataagacaatgatatgaacaaataatgcaaatattttgaaaatgtaaaaaagtgtaatgtttggaaaaatataaaatgctaaaatatttcattagccagaaaaaaaaaaa

SEQ ID NO: 1473 - DNA, 622 bp, dog
cggcatagcaaagaaaacaatccacacggtgagaaggaacctatgggagataatatttgcaaatcatgtatctgataaaagagtttaatatccaaaatgcataaggagaggcactgagaggctcagtcagtgaagcacctgactattgatttcaggtcaggtcatgatcccagggttgtaagatcagcatggagcctaagattctcgctatccctctccctctgtctatgcccctaccccctctctaaaaccacaaaagacaaaaaataaaaaaataaaaagaataaaaacaaaattcaaggaataaggaattcgtatgactcaataggaaaagaaattaataatgtgatttaaaaatgagcaaaatatcagaagacatttctctccaaagaaggtttatagatggccaacaagtaaataaaaagatgcttaataacaataatcctcaggaaatgcaaaacaaaatcacaatgagatatcacttcatacctgttaccatggctattattaaaaaaaaaaagcttaagcttcggcataggggaaatgggctttttagaagccaggaattctaagtatattctgttcttcaaataaatgtcattttcttctttaaaaaaaaaaa

SEQ ID NO: 1474 - DNA, 275 bp, dog
cgacgctggaaggggaatgaattacaacgttgtatccgaaagaagaaaatggttggaaatagaatgttccttgatgatctgcacaaacttaacaaacgcatcagctacctctataaacactttaatcgacatggaaagtaccggtaaaagagaaagctggaaactagaagaggcacatctgtcacgccggagaaggggaacagtacttttccttataagggaaggaatttgtatgctccctgtaataaaatggggcttctttggaaaaaaaaaaa

SEQ ID NO: 1475 - DNA, 303 bp, dog
tatttatcatgatcccaactggaaacaacgcagatgcccttcaatagttgagtggttagggacacctgacctggctcagtcagtagagcgtgggacttggggtctcggggctgtgagttcaagccccacatttgggcgtggagcctacttaaaaacaaaaacaaaaacagttgagtagttagttaaactgtggtatcctcgtgccatggaatacagtccagcaataaaaaaaagaacaaattattgatccctgcaacaatttggatgaatctccagagaaatgtgttgggtgaaaaaaaaaaa

SEQ ID NO: 1476 - DNA, 487 bp, dog
cagagacataggcagagggagaagcaggctccatgcactggggagcccgatgtgggattcgatcccgggtctccaggatcgcaccctgggccaaaggcaggagctaaactgctgcgccacccagggatccctagagattacttttaaaaagtaattaaacttttaaaaaaggagtggggtggggtgcctggctggcttagtcagaagagcatgtggctcttgatcttgggtttgtgagtttgagcctaacattgcatacagagattacttcaatacataaaacttttaaaatatatatataaatctaggcatacttaagctcaagacctcagtttttctcttattatgagtacaaaatgaaaacagtatctgtcccacatggttgatgaatggattaaatgagataacagatgtgaaagctctctgtaaatgataaggcactatacaaatatcattgctagctgtgcaggggggtgaaaaaaaaaaa

SEQ ID NO: 1477 - DNA, 379 bp, dog
tatttatcgagtcatccattctcccccacagcccactgaccgcggaacgatcttcttattctcctggagagtacctcccttttcttatttcctcttccaactccctccccaaaagttattttttaataattgtctttcctctgcattgtgtgttccttcttcccaacagctgaaatgcaagatagacaaatagaagagcaaaagaggggatccctgggtggcttagcggtttagcacttgccctcagcccagggcatgatcctggagaccccggatcaagtcccacgttggctccctgcgtggaacctgcttctccctctgcctgtctctctctctctctctctctcctgaagaaataaagtcttaagaaaaaaaaaaa

SEQ ID NO: 1478 - DNA, 141 bp, dog
gaagcgggaactgacacacctctcagagatgagccgatcaggaaaccaggtttctgaatacatttcaaatactttcttagataagcagaatgatgtggagattccatctcccacccagaaagaccgagagaaaaaaaaaaa

SEQ ID NO: 1479 - DNA, 153 bp, dog
ctccggaagttaaattaagaaaaaaatgttgtttctctatatgtcccttggaattaattcaagttttgggaataaggtaatcttaggaaagaagtcatgtgacatgaatatggactgtttaacacatggcattgaagatgtgaaaaaaaaaaa

SEQ ID NO: 1480 - DNA, 335 bp, dog
ctccggagacaggaaatggccattcagcaatcactgggggtgcgctgcccagaagacgagtacgcaggctacggttaccatagctaccaccaaggataccaggatggttaccaggatgactaccgtcatcatgagagttaccaccatggatacccttactgaacagaaatacgtaaccttagccccagccagtttcccctgcagctgttaaagccacaagtggcagctacgtaaagaagtttttccacactgcctacattccttgcctttttctttccgtgttcttccaaaattaaataaatagcaaacttttgtctactcgtgaaaaaaaaaaa

SEQ ID NO: 1481 - DNA, 296 bp, dog
gcggtgaaaggagtgtgtatgcctacgggtgtatgtattatttaggtagtggtatatgcctgggggatcaggaggtgcaaaaggaatcttctcagaagtaccctcttataattgcttctcaacagtttgcctgtttaggaaagatgtgctattttacagtgctcctttcagtgtggagagagatccaactgagttgtgaacttctgagaatattgggagaggaaaagaatgtcatgtgatttcttagtaggatttggggaaacatgataaagataatacgcttcgaaaaaaaaaaa

SEQ ID NO: 1482 - DNA, 343 bp, dog
gttggtattgctgtcttgtttttgatatgttcttgtattgactgcccattggcctgaaaatactcatcataagcctaaaaaaaaaaaatcatttttctttcccaccaactgttttatctgcttgttgtaagaatcaaatgaaataatgtatgtgaaagcaccttgtaaactgtaacctatcaatgtaaaatgttaaggtgtgttgttatttcattaattacttcttctttgtttagaatggaatttcctatgcactactgtagctaggaaatgctgaaaacaactgtgttttttaattaatcataacagcaaaattaaagtatcttcaaaggaaaaaaaaaaa

SEQ ID NO: 1483 - DNA, 198 bp, dog
gttggtattggaactagttttgggttgcctcaaaccaggtacggttttatttgagaaaaatttggaaaattttctgtattaatattttttcttactttttaaaattttcttattttgaacttctatttaatgtttcatattaaatgatgattaaagtattgttttgagtcaactaaacttctatttgaaaaaaaaaaa

SEQ ID NO: 1484 - DNA, 313 bp, dog
gcaagttatcctgatcacatattttattctatatgaaacttttggttatatatttctggggaactcagaggtcctagactcccaaaagtccttggagaatctctcattgaattatgcttttataatcagatgaaacaaaacactaactccctccctgaaactcactgcactatgtaaccctgcatgaattctctattgtattcaatgcctgtagctctttctcatataaactacattaacccttccaaaactctcacctatgatccacaattagggacttcctgagatcctgtcttacctggaaaaaaaaaaa

SEQ ID NO: 1485 - DNA, 222 bp, dog
gtctaaagatgtcagttttcctgattagcctataaatctaatgcatatcagcagatttatgtgttgaaaataaaggtttgagattaacaaagaaatttttaataaatagggaaggaaaatttgccctcctaaatatcaagacattttaaaaataagctaattaatactatactttttttcatagatatacacaattaaatcaatggaatagaaaaaaaaaaa

SEQ ID NO: 1486 - DNA, 194 bp, dog
gtctaaaccaggatgtaccaagtatgggaaaagagaacggggacgcctgagtggctcagtggtaaaagcgtctgcctttggctcagggcgtgatcccaagggcctgggattgagtcccgcatcaggattcctgcatggagcctgcttctccctctgcctctctatctttctgtgtctctcctgaaaaaaaaaaa

SEQ ID NO: 1487 - DNA, 207 bp, dog
acggggtgtgggtggaggagtccgggagaaggagagatcaggggagagcctggagacccccagcgagctgccgactgtggggccaggaggtgggaggcccctgattccaaggccatttttgagtgttttgctggaaatactccctgtatataaacttcttttacgctacaataataaaagcttgaagtaaactgctaaaaaaaaaaa

SEQ ID NO: 1488 - DNA, 445 bp, dog
gaagcgggtgtctaacgaggagaagttgaatctgtgccggaagtactacctgggtgggtttgctttcctgccttttctctggttggtcaacatcttctggttcttccgagaggcctttcttgtcccagcatacaccgaacagagccaaatcaaaggctatgtctggcgctcagctgtgggcttcctcttctgggtgattgtactcaccacctggatcactatcttccagatctaccggccccgttggggtgcccttggtgactacctctccttcaccatacccctgggtaccccctgataccttcctctgcaggcctgggctcattctcccaggatgtgctcctctactctaagctcactctcaagccccaaagacatgttcccatctcctatgttctttgtcgacatcccccaataaaggactctaattctctaaaaaaaaaaa

SEQ ID NO: 1489 - DNA, 395 bp, dog
gaagcgggagagacttgaggagtgacacccaggtttttggtttggtctgttggttgatagtcgtgttctttgagatggaggacccaggaggtagaacagatttgggaaggaacttgaatttgtttatgagtacaatgtatttttaagctgctgtggaatatcattgtaagagtttccaatatgcagttgggttatagggctaaagatgagaactgagttttgggctcggagctaaacattttattttagatggattctcagacatctggacaggctaagagcacctgaactgtgctcatccttgtgttatgctagtatcagggaaaagaaatactttgaatgtttctcagtctcgggcacttaaaccttcattcaaattgtgctaaaaaaaaaaa

SEQ ID NO: 1490 - DNA, 380 bp, dog
gaagcggcagatggagaagaagaagcagattccccactgagcaggaagccttactcaaggctcatcccaggatcttgagatcatgacctgagccagggcaggcgcttaactgactgagccacccaggtgcccttctcttttttttcttttatgtgcattccaagaatttcctcaaatttgtctcgcagatctcaaatttatttttatgtcatgtcatttcagtaaattcagcctttctactcaggatcttttaaaaatctttaatttttttgaaaaacgtttttttatggctcctttttcaaaatatcgtactcttgtttatggatacaatagtctcccaaatttccccgaaaacagtagtaacactttaaaaaaaaaaa

SEQ ID NO: 1491 - DNA, 329 bp, dog; identical to SEQ ID NO: 1237

SEQ ID NO: 1492 - DNA, 338 bp, dog
ggctgaccggctcctggaactaacaggcgcaattgataaaacaaaaaataataaacaggttcttgataagttgcaagtggaacgagaaagaggaatcactgttaaagcacagacagcgtctcttttctataattgtgaaggaaagcagtaccttctaaatctcatcgatacaccggtacatgtaatattttgtctctattgttgagtcagccttggattgattctgcaaacaaatccctgttcagtttttgaactgagcattaaacattttgcttttggttttctcagtgttttatgtttgagtcagttgtttcacaagtattgtctaaaaaaaaaaa

SEQ ID NO: 1493 - DNA, 243 bp, dog
cggtcctgggctgggtgtagtgtagatatttattgaaaagacagggggtgcctgggtggctctgtcagttaagcatccaattctcggttttggctcaggtcatgatctcaaggtcatgggattgagtctgcatggggctgtgcactcggtggggagtctgcttgagattctctccctttgcccctcccctcacttgtgcatgcatgctctctctttaaagtaaataaaccttaaaaaaaaaaa

SEQ ID NO: 1494 - DNA, 337 bp, dog
tagtccaacataagatgcggagaagcccaggagctcctacctggctcagtcagtggagcactcaactcgatctctgtgttgtaagttcaagccccatgttgggtgtggagattactgaaaaaagacaaaattttaaaaacaaacaaaaaaaagatatgaaggagcatagtgagattttcttaaagttaaatgtaattaaatgtccttttatgaagaaataatggtaacagatatttgtcttttgaataggtattttgtaagagaactgcattcggtgaataaagtggttgccaaccacatctccatcttcaaaacatgttttatctaaaaaaaaaaa

SEQ ID NO: 1495 - DNA, 218 bp, dog
tagtccatgcattgtgcagatgggtatttcccttttgattgaaagatggatatgggagttgtcatcttggaaactttataaatgagaaagggtatttttctactctgtaataactcaggaacaactggaaaaaatgttctctaactgtaactaaaatcaacctgcaggctaagtctaagcatgaaaatttcatcctaaatgatgtctaaaaaaaaaaa

SEQ ID NO: 1496 - DNA, 380 bp, dog
gacctttcagacagtgctactcttaaatttatttttgttcagatgaacatgtaactattgagcactttgtgctgtaaaataagagaaaaaactatagaaagatacagtgctatctgtgcttaagagctcattgggttaaaggcacgttgactcttgatctcagggcttggggttgaagccccactttgggtgtagatattacttaaaaataaaatcttttttttttttttttaaagtaggttctactcccagtgtggaacccatcatggggcttgaaatcaagaccctgagatcaagacctgagctgagatcaagagttggatgcctcaccaactgagccactggcatccccaaaataaaatctttattaaaaaaaaaaa

SEQ ID NO: 1497 - DNA, 262 bp, dog
gacctttgcaacaacatagagctgaagagtattatactaagcaaaataagtcacagacaaataccatatgattttactcatatgtggaattttagaaactaatgaggaaagagaaaaaagagagacaaatcaagaaacagattcttaattatagagaacaaaccaatggtcaccagagagtaggtgggggtgggtgaaataggtgatggggattaaagagtgcatttatcataatgagcactaagtaatgtaaaaaaaaaaa

SEQ ID NO: 1498 - DNA, 220 bp, dog
ttgaggttaaggctcaggattgtgttttttggcaacttgttagattcgtttacctagcgcttgaaaagtaggaaggtaaatgaatctagagtttaatcctcatgctaattctttaaaatcttaatggacaagggcgtttttaatactgaactatgaaggtagtgagaaattatgctatttagtgaaagtaacatacttgcccaatgtgtaaaaaaaaaaa

SEQ ID NO: 1499 - DNA, 370 bp, dog
acgttagatgtcatgaggaaactactgaactagcaaattggttgtttaacactctgtatgcaccaaacaacaactgtgagtagcctatgaatgaaaaatcttttataatccagtaataggcgtaaattaaaatgtaaatctccatccatagtggattaatgcattttgctgcctttattagggtactttattttgcttttcagacgtcggcctacataacacatttgtttttaaatccaaattgttcaatgactctttaaatattaatcgttgaattaaaaaaaagaacctaattcacttctcattatccgattcagaaataaattagaaaaaataggcttacatttttcacttttgctaaaaaaaaaaa

SEQ ID NO: 1500 - DNA, 304 bp, dog
acgttaggagaaaattgagagaacttaagtctcgaatgtaattggaatcttcaccttggagtggagttgaaaatgctatagcccaagtggctgtttactgcttttcattagcagttgctcacatgtcttggggtggggggaaaggaagaattggctatcttaaaaagtgggtaaaaaagctggttttagggcgtgtgttcaccttggaaatgttctatttaacaattgcgtcacgcacatgtggtgtaggaactttttctaccataagtgacaccaataaatgtttgttatttaaaaaaaaaaa

SEQ ID NO: 1501 - DNA, 170 bp, dog
gtctaaataaagtctaaactgtttaacagttccaaggaatatttgtgcaattaaaagagatggtcactcttggtctaacaaatgactactagatgttatagtaaaagaaagtccttcatggctaaaccaacagaatctcattattaattctcttttgggaaaaaaaaaaa

SEQ ID NO: 1502 - DNA, 138 bp, dog
gttggtatagaatgaaaacaaagctgcccattattttcttttaaatatgaaagaaaatgcactttgtgttgttgatgaaatgaggttcttccaagccttggtgattgtctttaatttcaaacagtctaaaaaaaaaaa

SEQ ID NO: 1503 - DNA, 162 bp, dog
gttggtattattagagttggtacttgagatagccttcacgggactgagagtttggaatggttatgactagactggtctgtagcctgcaaagggaaaaaataatgcctccgttatagttgacaaagtttggctaaagaagggatagggtgataaaaaaaaaaa

SEQ ID NO: 1504 - DNA, 404 bp, dog
aactgaggaatgatggaacgtttgtgctttgaatatttttaatgaatttgctttggttatattgaaagtatgacacagaacaccaatttgatgaggaataacccacaattatctggaggttaacaaagatgaggctatgtatttatttttcacagcaagttagttaacctgtttttgttttttcatatataaaaggagaataaaattaagccccatgtccctgggggaggaagtagtgagtattcataacaacttagaacagtgcctgacatactgtaaacattttgtaatgttactggtttcttgttgtttgcaaccagtgattgtttctctacagctcaatatagatagctgttgacgtgttctcttccttgcccatgttgtggcaataactaaaaaaaaaa

SEQ ID NO: 1505 - DNA, 101 bp, dog; identical to SEQ ID NO: 1388

SEQ ID NO: 1506 - DNA, 153 bp, dog
aactgagagtaggaatctcaactttcagaatgactaccaagattatatgtgaatatgttattaaataataaaataattataattgtaagattataataaaaactaatttaagtaaagtgacaacttattggtcaatataactaaaaaaaaaaa

SEQ ID NO: 1507 - DNA, 89 bp, dog; identical to SEQ ID NO: 1389

SEQ ID NO: 1508 - DNA, 205 bp, dog
aactgaggggaaataagatgtcacgggcaggggagaatcgtggtaaattaactccatcagtgcttacctggagccccttggaaatagcaagagggaggggcgcttgactggctcagttgggagagcacatgacacttgatctcaggggttgtgagtttgaggcccacactgggtacacttaaaaataaagtcttaaaaaaaaaaa

SEQ ID NO: 1509 - DNA, 379 bp, dog
cacagattcaaacgctaatctcatctggaaaaacctcacagttaacacccagaaatcatgtttaaccaaatatctggccacccctgcttcagtcaagttgacacataacgttaaccatcaaatctgagtttgcctgatagcatgacctctttctttcatctaataaaaaattgcaacctaatacccaggatgctacttcacttgattagattttactgtgtgtgtgtgtgtgtgtgtgtgtgtttaatatattcaaatattttcacagataggcctaaacattttgaatttgagagcattctgcatcctctgcattatttccttatcttgtaagttcacaactcttagtagatactaaaatgacacctaaaaaaaaaaa

SEQ ID NO: 1510 - DNA, 650 bp, dog
gcaagttgataaaagagtagattttaagtattctctctcacatacacagaaagaacaaagaaaaaaaagaaggtaattatgtgagctacagaggtattaattatccatattgtgtaacatttgcaatagatacatatatcaaatcaatacattatataagttcaagaacaacccaattttatgtgtcaattaaatttcaatgaactgaaacaataaaactttttcatcatattcatataagagtttgatttgtagttttctattgtgcatattatgggaatctatgatacaccccaggagacagaataattaaaacagggttgggattacctggtccttaaaggttggcaatatttctatgtgaagccatttggacctggtattttgtgtatttgtgtgtgttgggggggatactttaaacaattattttctatattactcttacgattattgctctatgtagactttctatactgggatcaatgttggtcaatttcataatgtatttttgtttatgtctcatatttattgactatctgctttaagaatgttgatgctatgctatgtggtgaataaatactcaaaactggagtttttgttaggatatgcctccttttgataacttttatattctttgtttaaaaaaaaaa

SEQ ID NO: 1511 - DNA, 179 bp, dog
gcaagttctatcgttcatttaaaaggaacattttgctatggttttcggaacatttctagataactcctaggtagttgggaagtgtttcagttgcttaaaatctgaagtcctttctgcttccactcttgttccttccatttcaatcttacaatagcctgtgtggtctttaaaaaaaaaaa

SEQ ID NO: 1512 - DNA, 286 bp, dog
caagaccacagccagttttctttctctgcttgtgtttaaaattttttttaatagagaatagtgtggagaatatatcccaattttagagcagcctcttatccctataagcttgctgtctctgtccactgaattactgaagtttgacactcttggaggaatatttttgtcataacccaccgcttgctgcactgtcgatccaattatttggaacaagcaatctgtcattctattgtttgactttggtgacaattttaaagaagaaactactttcaattaaaaaaaaaaa

SEQ ID NO: 1513 - DNA, 329 bp, dog
tgaattcaacagagaaaacatttccatccttgtactgaagtcttgtggtccacctggaacagccagacaagtagcccttctaagttcacagtctcttagaccttttctactactacttttagagtaacctctagggaataatattttttgtataattcataaatctctaatcaaggacaaggctaatacagtcaaaaaaaaaagtcaaaaaaaaaaaaggctaatacagtcataaatctgttttctgaactctccttcacatgaataattgccaacccattaaggaatattctaacataataaaagtaatttctgcataaaaaaaaaaa

SEQ ID NO: 1514 - DNA, 185 bp, dog
aaatcgattgggtgtctgactcttggtcttggctcacgttgtggtcttggggtggtgctcattgggctccttgctcagtggggagtctgctgcagattctctttccctctccctctgccccattcatgtgagcatgctctctctaaaaaaaaaaaaaaaaattagatatatgttaaaaaaaaaaa

SEQ ID NO: 1515 - DNA, 317 bp, dog
aaatcgagagttagatgcttaaccaactgagccacccaggagccccaatattatttaataatttctaattcaatcctgttgtagtcagagaatgccctttttatagtttctacccttttaaaatttatggaggcttatctgtcttggataaatatgctgtatgcacttaaaaagtgggtattctgtacctgatggatgcattgttctacatatgacaattagatcaagatggttaatagtattgtttgtatgttctctgtttttatcaatttactttctagccctacaatcctgggagaaggatgtaaaaaaaaaaa

SEQ ID NO: 1516 - DNA, 867 bp, dog
tgaattctgaagatcacactaagaacctttaagtcatgttagggtttcatttatttagtagtcataattcattatatttcatgcctatgttaagttctattacatgcagttttttgaaatttcctccttcatgaatcatactgggaattctacagctctttaaactgatcacctattctgtgtgtgttttgatttaaaatctttgaacgtagtaacctagagttagcaccgcctactggtttcttcttgaaaaatactgttctttgatgtagtaaggaacccacttggattctgatcagcttaatcatgcaaattattttcaaacgcctggagaaagagtttgggagataaaggtaaagagtgaaggcaagaagttgaataaattaaatgggctactgtgttctgcaattaaatggactactattagttgaccttgtgagttgcatttaaattttgacaaatcatcacaaagttaaaacagcctgttaaatttcctagaacttttctgtgggatgccaacgtttggacattttgaaaaatcctgggttactgaattgatttcacagtttatgttctaatcttgaacattgtagagaaagaaacccctagttggagtcttgtcttgggtgtgtggtttgtccaaacatttttgaatgaaatttttgttgttaaaaatgaacacattttccttatatttacccttatgtgattaaaaagcaagcgagtagtatacagatattttttcttactctgcatgaagtggccacactgtggtggtgttattatataagggcagaaagtttcaaacgcatacttacagaggcactctttatgttcttaacgctgccttttctttaaaaaaaaaaa

SEQ ID NO: 1517 - DNA, 130 bp, dog
tgaattcctaggccttgtaaaatgttcatatttgtttatgttttattctcagcttgcattttcatattaataaaatttttctgcatgttttttgtctggtatctactctctgatgctgtaaaaaaaaaaa

SEQ ID NO: 1518 - DNA, 150 bp, dog; identical to SEQ ID NO: 998

SEQ ID NO: 1519 - DNA, 137 bp, dog
aaatcgagagtcagacacttaactaactgtgccactgacacgcccctgaataataatgttttgaatattaataaatgaagtatttagagagttttacatcatgcagattaaattcaatttccaaataaaaaaaaaaa

SEQ ID NO: 1520 - DNA, 277 bp, dog
ctatttcaccaaggaccctgggaatagcagaaaagtgaagtcctttttttccagtcctacttaaaaaggtgcatatgtgtccttcccagtgtctctgagattcaaatatcctccctttgaaggtgacccctccattttagtccattttatcccattgtctccaatctcctccaggtctctttctctcttgtactttgtctctacctttcctctgactctatttccacatcaatagacataaacaaatctctcctgccccatgtcttaaaaaaaaaaa

SEQ ID NO: 1521 - DNA, 246 bp, dog
ctatttcacaaactcatttgactatggaaccctataaataacgtctattaacatctgacagaggaacacgtttttggaaactatgccctaagcaatcttcctctttccattccaaattaaacacatccagcaggtttacttggaagtgaaaagaatggaactgagacttatttatgatgggttcaagaactaaaagccttttaataaatataaaatttcagtagaattgacttgtaaaaaaaaaaa

SEQ ID NO: 1522 - DNA, 134 bp, dog
cgaaatgtcacccttccagaaatattctgagaccaaatttacaaaaaaaaaaaaagaaagaaagaaaaaaaaaggattgactgggctacctcagcatacatttctgccacattcttaagtagcaaaaaaaaaaa

SEQ ID NO: 1523 - DNA, 48 bp, dog
ctcaacgataaataaacctttggggcttttcatttctaaaaaaaaaaa

SEQ ID NO: 1524 - DNA, 184 bp, dog
ccacgtactgcacagggaacagggtgagggcaagacacgctttactcaaaaccacacagtgaggccctcccccaggtcttctgtttgagctctgactgaaaaaaacattttcaggacaaaactaccatgtgacctatgagcatattcactctttgctcctaaatcatttgtggaaaaaaaaaaa

SEQ ID NO: 1525 - DNA, 227 bp, dog
gagtgctaggttctgtaataggagtcacatattttaaggtgtgtgtgtgtatatatgtgtgtatgtgtgtgtgtatgcacacataccttgatgggtcagtcggttaagtgtcgctttgttttgacacatgtcatgtgagatcaagcctgagtccatcgtggtgctgggcatggagcctacttgattctctccctcactccttcccctcttccctcgaaaaaaaaaaa

SEQ ID NO: 1526 - DNA, 289 bp, dog
cattccgtaaagagcagttgtgctaggggatttagtacaacatgatgactagagctaacactgccgcatgatatatatggaacgtatcaagagagtaaatcctaagaggtttcatcacaaggaaaaaaatatatatgtacatgtagtttttatatctgtatgagatggtggatgttaacttatggtaaccattgcatgctatgtgtaagtcaaatcattatgctgtacaacctaaatgtatacagtgctgtatgtcaactctatttgaatgaaactggaaaaaaaaaaa

SEQ ID NO: 1527 - DNA, 53 bp, dog
gagtgctaataattttgtccaataaatgtttattgccttgctaaaaaaaaaaa

SEQ ID NO: 1528 - DNA, 201 bp, dog
ccacgtaggctaaaaatagcaattaaatggcattgatgttcttttttaccttgttgccatgagaaataattgtcctcttctgccctacataccagttgtactcccagctaacatcctcattatcacttgacagttcaactgctaaaagattgctgtttttatataattattcttattagccatttttcataaaaaaaaaaa

SEQ ID NO: 1529 - DNA, 202 bp, dog
taaagtaggtatgtttatcgtaataattcttcttctgtagtaaattcaagttttaagttttacagttgcttaagatattttaaatatgtaagtctcttatgcagaagacaattacagaaatccttattgtcaattgataatgccattttccggtatttgttcagatgcccaacatctgtattcttcccccccttacgaataa

SEQ ID NO: 1530 - DNA, 664 bp, dog
acgttaggattcacaaccaacctgttaaccatataccagtgatgacgagatgtgatccgagaaggcacattccaaggacatcatacccctattgtacaaaaaggactacgatacggaatagttctttttatcgtatcagaagtatttttctttgcaggcttcttctgagccttttaccactccagcctagcccctactcctgaacttgggggttgctgacctcctaccggcattattcctcttaacccattagaagtgcctctactcaacacctcagtcctcctagcctccggagtatctattacttgagcccatcatagtttaatagaaggtaatcgcaaacatatacttcaagccttattcattacaatctccttaggcgtatattttacgctattacaggcctccgaatactatgagacatcttttacaatctccgatggggtatacggatctaccttttttatagccactggatttcacggattacacgtaattattggctctacattcctcatcgtgtgcttcctccgacagctatactaccacttcacatcaaaccaccacttcggatttgaagccgctgcatgatattgacactttgttgatgtagtctggctattcttgatgtatctatttattgatgaggatccaaaaaaaaaaa

SEQ ID NO: 1531 - DNA, 167 bp, dog
gacctttacctaccaaagtggctgtttttcagtcaaccagaggagctttcttagtgcaactcttacattccaaataattatgtcgtagagaacggttttaattgttgcactttaattactttggttcactattattgctgcattgagattttcaccaaaaaaaaaaa

SEQ ID NO: 1532 - DNA, 160 bp, dog
cgaaatgccaagttgatggagtggctaaagagtacagattatggaaaatacgagggactaacaaagaattacatggattatttatcacgactatatgagagagaaattaaagatttctttgaagttgcaaagatcaagatgactggcacaaaaaaaaaaa

SEQ ID NO: 1533 - DNA, 138 bp, dog
cgaaatgtcacccttccagaaatattctgagaccaaatttacaaaaaaaaaaaaaaagaaagaaagaaaaaaaaaaaggattgactgggctacctcagcatacatttctgccacattcttaagtagcaaaaaaaaaaa

SEQ ID NO: 1534 - DNA, 132 bp, dog
gacctttgtgacgtcctagctgaaaagctatttatacccactattgccgcaactgtgagaaactagacatgagagaagagtgggcactaaatgtggcctcctcaggagcacctcccgggccaaaaaaaaaaa

SEQ ID NO: 1535 - DNA, 166 bp, dog
gacctttactgagccctatgcataatccagccatcatactagatgttttcttatatcccatttatcctcataaccaccctgaaaaatagaggcccatatccccaattccagatggaggaactgagaagtggctaggcaaaaatcctcttccttccaaaaaaaaaaa

SEQ ID NO: 1536 - DNA, 178 bp, dog
gacctttagctgaaatgtttaggtagcttctggtgatatccttttataaatttatgtctcttaaaagggtgatagaggggatacctcatagaaaggagctttgaactgtatataactcctaaagaggacttcattttagagaattaaaatatttgtgctcaactgccaaaaaaaaaaa

SEQ ID NO: 1537 - DNA, 228 bp, dog
caatgcaaacatgccaggctctctggctctctgaaaaagagccttctccctgagcctggaatgtggaagacaaacactgtcccatctttcccagctaatgaggacttctggaatgtgtgagctatggcaacttgccgccaagaactatgtttgggggagcccccacaattaagtggaatcgaagatcattagaagacagagttatgacagccccttcaaaaaaaaaaa

SEQ ID NO: 1538 - DNA, 146 bp, dog
aaatcgattgggtgtctgactcttggtcttggctcacgttgtggtcttggggtggtgctcattgggctccttgctcagtggggagtctgctggagattctctttccctctccctctgcccccattcatgtgagcatgctctctcta

SEQ ID NO: 1539 - DNA, 244 bp, dog
tttttttttttactatttataccttattttggctctttgtttcttttaataagataattttgaaatattaaactgtaaagccttttcctgtttgtttgaaaagtccaagaatgtacttatacaggcatttcccttgctattttatgccattctgcataccacaaactaaagactgaaattatttgtctgttgtagcttcattttttatcagtagttcttttgtcagctgctttaaaaaaaaaaa

SEQ ID NO: 1540 - DNA, 129 bp, dog
gcctttatcttgttttggtatcagggtaatgctggtttcataaaatggatttggcagtcttctttcctcttctattttttgaatagtttgaaaagaatacatgttaactcttcttttataaaaaaaaaa

SEQ ID NO: 1541 - DNA, 159 bp, dog
caagaccataatattttttcatggctgcatgatatttaatcaaatggatatacaattatttatttaacttttgctcggttgttggatacttaggtgtaatacttatgtatagtattataaatatgccataataaatatgtttgtgcctaaaaaaaaaaa

SEQ ID NO: 1542 - DNA, 207 bp, dog
gcaagttaaatgtatggtgagatgtattgcacacccactgtccgcaagattggagaggatgtggaaccactggaacgctcctgtactgttggtgaaaatgtaaaatggtgcaaccactttgcaaaactgtttggtaccttcttaaaattgagctgccacttgattcagtcatcccactgtgagctgtttatccatgaaaaaaaaaaa

SEQ ID NO: 1543 - DNA, 251 bp, dog
aataacggtgcacttattaacttacgactctcgagagtccagataacagctctgtaactttgtgcactgcagcgaagaacaaatgctaaaataggagtttcgcttaacctcagatttgaaattgatgattgagtcctaccaaatttttagttcagtgttgttaattagaagagcagtttgatcctcctatgctgttttagagttgaatttcgcatacataactgctgtaatcctgtaaggaaaaaaaaaaa

SEQ ID NO: 1544 - DNA, 612 bp, dog
acgatgcaccaaacaccatacagagcagcaattctcaaacacctcggcctcagtactctgcagtgttataattccctggagaaaataaaataagcctcgtccatattaacacaaacattcatatgaaaaataaatatattttccaaaaccactaagagtgccgttgtttcacatttctacaaacctccttaaaaagatttaagagaaatggatcctcacattttgttctgcctttgttgccagttatgtggtctctgaaaaacccacgctgcccacttgtgagagaacaagagggaaaaggataatgttattatccttctatagtattattgtcctcttaaaatattatgaacatactttcaactcatgaatcctctcactgctgacaaggtgatactaaagaacaaaaaagataaaggtagatctaaaaactaatctgaccatgaaaaaacaaaaacacatggactaaagtcatcagccaaagagagggaatggaatacataggaccttctggaaccttgtgtgaccttcagttaggcaaagagctcttgaatatataacattaaaagtacaatattcttcaaaaggcaccattaagatgaaaaaaaaaaa

SEQ ID NO: 1545 - DNA, 356 bp, dog
ctgctggctttacaacattatggtgacagagaaaagtgagagacactattatccttacttgaggtacaaagcgtcaaatcaaagacatgccgatgtccccatagagcttaccatccagtgaggtaaagaaacaagtaaataagaattataatggtgatcactaccattcagttccagaacactacaataaagtgaatattgcagtaaagtgagtcaaatgaatttcttggtttcccagtatacataaaatctgtgggtacactatgctatagtctattaaatgtacaatagtattatccaaaaaaccagtgtatatatacctttgttaaaaaatacttcattgcgaaaaaaaaaaa

SEQ ID NO: 1546 - DNA, 568 bp, dog
gccatggcacaaagtattccacgtagtcattgaaattaaagctgtattcgtcagttatggattgtgaacataaatgttttcaattcaaacatcttcaaaatttactgcaatgaattttgatgaaaatggcaatagagcatcaataaaccttaagtgaaacagaggtcagaaatttggagatataggagaggagttggaggctcctgtacagatttactgattgaatctaattggaataagtaaatagtaaagtactttagagagccttaactgatgtaaaaacgtgcatgcatgcatgttgaattgcattataacataaatgactcaaaagagcactgaaattttggttttatatgagttaatcttatactccattcaaagttgttggattttattagccatgtatccgatgtgtaacaaactcctgtgacacagatactgatgatggctgtaataataattggacttagtgaacatctagtagtttgataagtaacatgattgttctacatggcaatgagagaaatcctatgtcaaccaatggtcatgcatatcagaaaaaaaaaaa

SEQ ID NO: 1547 - DNA, 257 bp, dog
cactagcgggcaagagagagaagaattctagttttagctgcattactactgaagatacagaaggtaagcttgtacattcacccttgggaggttagtaaatggaatttgtttaaaagtctcttcagatatctagcacttacttgggaataaaaatgactccataaagtaggttaaaaatttttttttcatatctatcccagaaaagaatcattggtttgtatgaagaaatcttaacaacaacagaggaaaaaaaaaaa

SEQ ID NO: 1548 - DNA, 375 bp, dog
cactagctggcacatacactgggccataaaataagcattattaaatttgaggaagtttgaaatcttacaaactgtgttctcttatcacatttaaattacaaaccaacagttggtatacatgaaaaaagccataaatagtttgaaaataaacaccacacttcataataacccctgggtcaaagaaaaaaagaaaacgagaagagaaattagaaaatatttcaaactaagagaaaatgaaaacaaaacattaaaagtgtggaggatgctcctataagcagagtttggagggaaatttaatctctaaatatttatatggaataaaaaaattaagaacaaagacctaagattatacagtaaggagtggaaaaaaaaaaa

SEQ ID NO: 1549 - DNA, 690 bp, dog
ttttttttttttaggaaataaattagggggagaaaaaagaagttagggaaataaacaaacaaaaaatcagggaattacttaaggagtctatcagagaaagagccaaaatcaaaatgtctagagacactgatatgaggactgataataagcaagacatacatagttatctgcaggaataagaccaaatgagtcttaaaaggaagatattttgtatgtaatggctatagggtctgacagtgtagatgtagtacaaccatagaaaaaagtggagaaaaatgagtgtatgacaaagacattatctttattgttttaatcatcaaaatttattatttggagacggctcatgtgtaatgcaggacaatcaaatgggttataagacattctatctcccctgtaactaaaaaactaggattctaagtctgtaagaagcaaaatacaaatgtaataaagaagaggttaaacaaaaacctgtaatcttgaacttgccttggaaatatcattatgaattcacagtacattttatttttatatgtgtatatatatgtttgtatgtagatgtatatatgtctatgtatgtgtcttcccagctctgaccagtaaaatgacctaaaaacgatagccctccagtgaatgagcatccctagtgactggattatggcctgaaatatcaattcttatttaaaaaaaaaa

SEQ ID NO: 1550 - DNA, 176 bp, dog
cgacgctgtgtgggtccccaatgtacatggctcctgaggttattatgtctcaacattatgatgctaaggcagacctgtggagcataggaacagtggtatatcaatgcctagttggaaaaccaccttttcaggccaatagtcctcaagacctaaggatgttttatgaaaaaaaaaaa

SEQ ID NO: 1551 - DNA, 186 bp, dog
gccatggcccctccttcatgatcccccacatgcaccccattagcatttacctccatatatctaccatgacttctatgaatccattctccatattttttatagctttgcaattatgaaacaaattttgtgtgtgcttataaaacttttaaatacataagatataagactcatttagaaaaaaaaaaa

SEQ ID NO: 1552 - DNA, 400 bp, dog
tcctggatgaagatggagcaatgatctcagtcaattcattatcttgtccagtttgactaccagctgtattatgggaatctaccagtactttttataaattgtgtttaaaaatgtatatctagtactatctctctgaatgctatttaagaaaattatgcaactgagataaggtaataaactaggcagcagtagccttaaacattgaagtgtgaggaagaagcactttcagatatgctaagcagacttaaagaacctttttgtattgctatttgtaaactaaataagccatcaattttgtggcattgctttaaatagaaactctgacactttaaaaaatgaccatcatgtttaatgttttcactaaaaagttcttctattttgtaatttggaaaaaaaaaaa

SEQ ID NO: 1553 - DNA, 103 bp, dog
aacgaggtggaaaataaggtcagggaaagtacatcaggtagaaaatgaaaagctaggacaaccgctgaatataggcacataagatagacgtcaaaaaaaaaaa

SEQ ID NO: 1554 - DNA, 145 bp, dog; identical to SEQ ID NO: 253

SEQ ID NO: 1555 - DNA, 274 bp, dog
tttttttttttgcaaagttaacatttttattgaactgaaattggtgtagaacaaaagggaccaccacagctgctgagctttgtaacaactgaaaagtccctgtgacattttacctttgagagtcctaacatggtttgggtgtaacaactgagaaacaagtgtgtgtgtgtatacacacacacactccacttcaaaatattagtgaaatgagcctcccagccttgtttagttttagattacaaagaacaatgataacatcttctgttgcctttat

SEQ ID NO: 1556 - DNA, 138 bp, dog
ttgaggtgacccagaaacttgagctgtgacgaatgcacccagataggtttacccaactcaaagagaattgggttcaaactccctttgccatcactgtctttctttcacagcaaacaagagtatttccaaaaaaaaaaa

SEQ ID NO: 1557 - DNA, 143 bp, dog
caagaccgttggcagtgttaaacgttacctgtgaacttcaactgtgtgatagtcaccggcttttgtattgttctcttacatggatgtgggggttctaattttgtcaaataaactgttctttatctgttgctgtaaaaaaaaaa

SEQ ID NO: 1558 - DNA, 214 bp, dog
ttgatccagcaagcaacaactgttaaaaacaaggatatcagaaaatttttggatggtatctatgtttctgaaaaaggaacagttcagcaggctgatgaataagctctgagttgtccagcaacagaaacagcaagatgccagatgatttttcagacttatttgtgataccttaagaatgcaataaaaactacacagttctggggaaaaaaaaaaa

SEQ ID NO: 1559 - DNA, 16 bp, Artificial
  Oligonucleotide Primer
aagctttttttttttg

SEQ ID NO: 1560 - DNA, 16 bp, Artificial
  Oligonucleotide Primer
aagctttttttttttc

SEQ ID NO: 1561 - DNA, 16 bp, Artificial
  Oligonucleotide Primer
aagcttttttttttta

SEQ ID NO: 1562 - DNA, 16 bp, Artificial
  Fluorescein-labeled primer
aagctttttttttttg

SEQ ID NO: 1563 - DNA, 16 bp, Artificial
  Fluorescein-labeled primer
aagctttttttttttc

SEQ ID NO: 1564 - DNA, 16 bp, Artificial
  Fluorescein-labeled primer
aagcttttttttttta

SEQ ID NO: 1565 - DNA, 17 bp, dog
cgacaacaccgataatc

SEQ ID NO: 1566 - DNA, 17 bp, dog
gacgcgaacgaagcaac

SEQ ID NO: 1567 - DNA, 23 bp, dog
gtcatcatctctgctccttctgc

SEQ ID NO: 1568 - DNA, 23 bp, dog
tgacaatcttgagggagttgtca

SEQ ID NO: 1569 - DNA, 27 bp, dog
cttctcatggttcacgcccatcacaaa

SEQ ID NO: 1570 - DNA, 30 bp, dog
ttgatactcctagtcttgtctattcactga

SEQ ID NO: 1571 - DNA, 23 bp, dog
tcgagtttttgctctttggagaa

SEQ ID NO: 1572 - DNA, 27 bp, dog
tcattcaacccagcattgaacaaggct

SEQ ID NO: 1573 - DNA, 22 bp, dog
agcaggtgttcatcccagaatg

SEQ ID NO: 1574 - DNA, 19 bp, dog
gggtgtgacgcaccaacag

SEQ ID NO: 1575 - DNA, 26 bp, dog
cctacagccaggtgcagtgtcacagc

SEQ ID NO: 1576 - DNA, 17 bp, dog
gcatccccgagcctcat

SEQ ID NO: 1577 - DNA, 23 bp, dog
gggtgctatacagtccaggtcaa

SEQ ID NO: 1578 - DNA, 25 bp, dog
tctatctccccagctgcttccccac

SEQ ID NO: 1579 - DNA, 27 bp, dog
aaggaagtccaataaattctttgtttg

SEQ ID NO: 1580 - DNA, 21 bp, dog
tgccaggattgttggtctgtt

SEQ ID NO: 1581 - DNA, 31 bp, dog
ctcctgctgttaccccagtgaagagtgtttt

SEQ ID NO: 1582 - DNA, 18 bp, dog
caggctgccaacgaatgg

SEQ ID NO: 1583 - DNA, 21 bp, dog
agaccggctcttgaggacaga

SEQ ID NO: 1584 - DNA, 27 bp, dog
tggcctgcctgacaagtactgagcttc

SEQ ID NO: 1585 - DNA, 23 bp, dog
ccatcttttctccctcctcaact

SEQ ID NO: 1586 - DNA, 20 bp, dog
ggtcttcaggtgatggtggg

SEQ ID NO: 1587 - DNA, 24 bp, dog
tcttcagcgggactccctcttggg

SEQ ID NO: 1588 - DNA, 26 bp, dog
agtttggctccctaagtagatcactt

SEQ ID NO: 1589 - DNA, 27 bp, dog
gaatacagctaccaccaactttcaatt

SEQ ID NO: 1590 - DNA, 31 bp, dog
ctaaatgctttggatgattgtccgcttctca

SEQ ID NO: 1591 - DNA, 22 bp, dog
tgaacatgctaacctgcgtctc

SEQ ID NO: 1592 - DNA, 20 bp, dog
gacgtgttttctcggctgga

SEQ ID NO: 1593 - DNA, 23 bp, dog
cccacgtagtccgtgggagaccc

SEQ ID NO: 1594 - DNA, 24 bp, dog
catgttggttctgaaaaggtctga

SEQ ID NO: 1595 - DNA, 21 bp, dog
ggtgagccaaaagccatagct

SEQ ID NO: 1596 - DNA, 30 bp, dog
cctttactccgtgcagatctactgctcagc

SEQ ID NO: 1597 - DNA, 25 bp, dog
tgtgttttgtttgttttgcttgttt

SEQ ID NO: 1598 - DNA, 27 bp, dog
agaaagaaaaaaggaaagatgagttca

SEQ ID NO: 1599 - DNA, 25 bp, dog
cgccccccaaaccttttgttctctc

SEQ ID NO: 1600 - DNA, 27 bp, dog
actatttcataccctctcccactacaa

SEQ ID NO: 1601 - DNA, 30 bp, dog
cccacaaatacaatttatatttagcagtga

SEQ ID NO: 1602 - DNA, 33 bp, dog
tttccgtgcagttacctttcatttttaaagcaa

SEQ ID NO: 1603 - DNA, 22 bp, dog
acaagacatcctaccgctggtt

SEQ ID NO: 1604 - DNA, 21 bp, dog
cagctcaggaccctcgtagaa

SEQ ID NO: 1605 - DNA, 21 bp, dog
ctgcagcatcggccccaagtg

SEQ ID NO: 1606 - DNA, 24 bp, dog
tgagattcaacacttcccagtcaa

SEQ ID NO: 1607 - DNA, 21 bp, dog
tgtccccatggttaggtgaca

SEQ ID NO: 1608 - DNA, 30 bp, dog
tatttacatcaggcaaagcagcatcagcaa

SEQ ID NO: 1609 - DNA, 34 bp, dog
aaataacaaaaggtgaaacttctatacaaatatt

SEQ ID NO: 1610 - DNA, 30 bp, dog
aagtttgtaagacacttaaactctttctgc

SEQ ID NO: 1611 - DNA, 36 bp, dog
ccaaaaattctttactcagtcacacaacaaatgagg

What is claimed:

1. A method to diagnose a canine subject who exhibits signs of osteoarthritis, the method comprising:
    a) obtaining a cartilage sample from the canine subject;
    b) measuring in the sample the amount of a transcription product comprising SEQ ID NO:217, wherein the measuring comprises hybridizing one or more probes capable of specifically hybridizing to the transcription product, wherein the probes comprise at least 10 nucleic acids, and wherein the probes are identical to or are fully complementary to a corresponding region of the transcription product to which they specifically hybridize and the corresponding region distinguishes the transcription product from any other transcription product in the sample;
    c) determining if the transcription product comprising SEQ ID NO:217 measured in step b) is down regulated in comparison to a non-osteoarthritis cartilage sample; and
    d) diagnosing the canine as having osteoarthritis when SEQ ID NO: 217 is down regulated in comparison to a non-osteoarthritis cartilage sample.

2. The method of claim 1, wherein:
    step b) further comprises measuring in the sample the amount of at least one other transcription product produced by the expression of one or more genes known to be differentially expressed in an osteoarthritis cartilage sample as compared with a non-osteoarthritis cartilage sample, the transcription product comprising any of SEQ ID NOs: 1-216 and 218-1558;
    step c) further comprises determining if the transcription product measured in step b) is differentially expressed in comparison to a non-osteoarthritis cartilage sample; and
    step d) comprises making a diagnosis or prognosis of osteoarthritis in the canine based upon whether indications of osteoarthritis are present given the determination of step c).

3. The method of claim 2, wherein the differential expression in comparison to a non-osteoarthritis cartilage sample is at least 1.5 fold.

4. The method of claim 2, wherein the one or more probes is a collection of 50 or more probes.

5. The method of claim 2, wherein the one or more probes is a collection of 200 or more probes.

6. The method of claim 2, wherein the transcription product comprises any of SEQ ID NOs:1-216 or 218-396.

7. The method of claim 2, wherein the transcription product comprises any of SEQ ID NOs:1-216 [217].

8. The method of claim 2, wherein, if the transcription product is up-regulated in comparison to a non-osteoarthritis cartilage sample, it is selected from the group consisting of SEQ ID NOs: 1-4; and if the transcription product is down-regulated in comparison to a non-osteoarthritis cartilage sample, it is selected from the group consisting of SEQ ID NOs: 5-216.

* * * * *